United States Patent 10,100,349 (METHODS OF DETERMINING POLYMORPHISMS) - sequence listing, part 3

SEQ ID NO: 18059 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (10)..(10): base is a locked nucleic acid
cmmrcargatttg

SEQ ID NO: 18060 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (8)..(8): base is a locked nucleic acid
  modified_base (9)..(9): base is a locked nucleic acid
tcmmrcaraattt

SEQ ID NO: 18061 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (3)..(3): base is a locked nucleic acid
tcmmrcaraattt

SEQ ID NO: 18062 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (1)..(1): base is a locked nucleic acid
tcmmrcaraattt

SEQ ID NO: 18063 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (4)..(4): base is a locked nucleic acid
tcmmrcaraattt

SEQ ID NO: 18064 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (7)..(7): base is a locked nucleic acid
tcmmrcaraattt

SEQ ID NO: 18065 - DNA, 14 bp, Artificial Sequence
  Oligonucleotide probe
  misc_binding (1)..(14): Hybridization probe for the specific detection of mutant HIV-1 at codon 138 of the integrase gene.
tcmmrcaraatttg

SEQ ID NO: 18066 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (9)..(9): base is a locked nucleic acid
tcmmrcaraattt

SEQ ID NO: 18067 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (12)..(12): base is a locked nucleic acid
tcmmrcaraattt

SEQ ID NO: 18068 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (10)..(10): base is a locked nucleic acid
tcmmrcaraattt

SEQ ID NO: 18069 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (7)..(7): base is a locked nucleic acid
  modified_base (8)..(8): base is a locked nucleic acid
  modified_base (9)..(9): base is a locked nucleic acid
tcmmrcaraattt

SEQ ID NO: 18070 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (5)..(5): base is a locked nucleic acid
  modified_base (8)..(8): base is a locked nucleic acid
  modified_base (9)..(9): base is a locked nucleic acid
tcmmrcaraattt

SEQ ID NO: 18071 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (2)..(2): base is a locked nucleic acid
  modified_base (8)..(8): base is a locked nucleic acid
  modified_base (9)..(9): base is a locked nucleic acid
tcmmrcaraattt

SEQ ID NO: 18072 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (3)..(3): base is a locked nucleic acid
  modified_base (8)..(8): base is a locked nucleic acid
  modified_base (9)..(9): base is a locked nucleic acid
tcmmrcaraattt

SEQ ID NO: 18073 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (12)..(12): base is a locked nucleic acid
tcmmrcaraattt

SEQ ID NO: 18074 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (10)..(10): base is a locked nucleic acid
tcmmrcaraattt

SEQ ID NO: 18075 - DNA, 14 bp, Artificial Sequence
  Oligonucleotide probe
  misc_binding (1)..(14): Hybridization probe for the specific detection of mutant HIV-1 at codon 138 of the integrase gene.
  modified_base (8)..(8): base is a locked nucleic acid
  modified_base (9)..(9): base is a locked nucleic acid
tcmmrcaraatttg

SEQ ID NO: 18076 - DNA, 13 bp, Artificial Sequence
  Oligonucleotide probe
  misc_binding (1)..(13): Hybridization probe for the specific detection of mutant HIV-1 at codon 138 of the integrase gene.
  modified_base (8)..(8): base is a locked nucleic acid
  modified_base (9)..(9): base is a locked nucleic acid
  modified_base (11)..(11): base is a locked nucleic acid
tcmmrcaraattt

SEQ ID NO: 18077 - DNA, 18 bp, Artificial Sequence
  Oligonucleotide probe
  misc_binding (1)..(18): Hybridization probe for the specific detection of mutant HIV-1 at codon 138 of the integrase gene.
tcmmrcargatttggvat

SEQ ID NO: 18078 - DNA, 18 bp, Artificial Sequence
  Oligonucleotide probe
  misc_binding (1)..(18): Hybridization probe for the specific detection of mutant HIV-1 at codon 138 of the integrase gene.
rtcmmrcaraatttggva

SEQ ID NO: 18079 - DNA, 17 bp, Artificial Sequence
  Oligonucleotide probe
  misc_binding (1)..(17): Hybridization probe for the specific detection of mutant HIV-1 at codon 138 of the integrase gene.
cmmrcargatttggvat

SEQ ID NO: 18080 - DNA, 17 bp, Artificial Sequence
  Oligonucleotide probe
  misc_binding (1)..(17): Hybridization probe for the specific detection of mutant HIV-1 at codon 138 of the integrase gene.
tcmmrcaraatttggva

SEQ ID NO: 18081 - DNA, 15 bp, Artificial Sequence
  Oligonucleotide probe
  misc_binding (1)..(15): Hybridization probe for the specific detection of mutant HIV-1 at codon 138 of the integrase gene.
cmmrcargatttggv

SEQ ID NO: 18082 - DNA, 15 bp, Artificial Sequence
  Oligonucleotide probe
  misc_binding (1)..(15): Hybridization probe for the specific detection of mutant HIV-1 at codon 138 of the integrase gene.
tcmmrcaraatttgg

SEQ ID NO: 18083 - DNA, 13 bp, Artificial Sequence
  Oligonucleotide probe
  misc_binding (1)..(13): Hybridization probe for the specific detection of mutant HIV-1 at codon 138 of the integrase gene.
cmmrcargatttg

SEQ ID NO: 18084 - DNA, 13 bp, Artificial Sequence
  Oligonucleotide probe
  misc_binding (1)..(13): Hybridization probe for the specific detection of mutant HIV-1 at codon 138 of the integrase gene.
tcmmrcaraattt

SEQ ID NO: 18085 - DNA, 15 bp, Artificial Sequence
  Oligonucleotide probe
  misc_binding (1)..(15): Hybridization probe for the specific detection of mutant HIV-1 at codon 138 of the integrase gene.
aaacagaartttgga

SEQ ID NO: 18086 - DNA, 15 bp, Artificial Sequence
  Oligonucleotide probe
  misc_binding (1)..(15): Hybridization probe for the specific detection of mutant HIV-1 at codon 138 of the integrase gene.
aaacaggcrtttgga

SEQ ID NO: 18087 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
argaatttgvatycccta

SEQ ID NO: 18088 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (6)..(6): base is a locked nucleic acid
argaatttgvatycccta

SEQ ID NO: 18089 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (4)..(4): base is a locked nucleic acid
argaatttgvatycccta

SEQ ID NO: 18090 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (7)..(7): base is a locked nucleic acid
argaatttgvatycccta

SEQ ID NO: 18091 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
argaatttgvatycccta

SEQ ID NO: 18092 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (16)..(16): base is a locked nucleic acid
argaatttgvatycccta

SEQ ID NO: 18093 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (15)..(15): base is a locked nucleic acid
argaatttgvatycccta

SEQ ID NO: 18094 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (18)..(18): base is a locked nucleic acid
argaatttgvatycccta

SEQ ID NO: 18095 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (12)..(12): base is a locked nucleic acid
argaatttgvatycccta

SEQ ID NO: 18096 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (5)..(5): base is a locked nucleic acid
  modified_base (9)..(9): base is a locked nucleic acid
  modified_base (10)..(10): base is a locked nucleic acid
argaatttgvatycccta

SEQ ID NO: 18097 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (4)..(4): base is a locked nucleic acid
  modified_base (9)..(9): base is a locked nucleic acid
  modified_base (10)..(10): base is a locked nucleic acid
argaatttgvatycccta

SEQ ID NO: 18098 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (10)..(10): base is a locked nucleic acid
argaatttgvatycccta

SEQ ID NO: 18099 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (2)..(2): base is a locked nucleic acid
  modified_base (9)..(9): base is a locked nucleic acid
  modified_base (10)..(10): base is a locked nucleic acid
argaatttgvatycccta

SEQ ID NO: 18100 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
  modified_base (14)..(14): base is a locked nucleic acid
argaatttgvatycccta

SEQ ID NO: 18101 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
  modified_base (18)..(18): base is a locked nucleic acid
argaatttgvatycccta

SEQ ID NO: 18102 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
  modified_base (15)..(15): base is a locked nucleic acid
argaatttgvatycccta

SEQ ID NO: 18103 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
  modified_base (13)..(13): base is a locked nucleic acid
argaatttgvatycccta

SEQ ID NO: 18104 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
cargaatttgvatyccct

SEQ ID NO: 18105 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (5)..(5): base is a locked nucleic acid
cargaatttgvatyccct

SEQ ID NO: 18106 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
cargaatttgvatyccct

SEQ ID NO: 18107 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (3)..(3): base is a locked nucleic acid
cargaatttgvatyccct

SEQ ID NO: 18108 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (8)..(8): base is a locked nucleic acid
cargaatttgvatyccct

SEQ ID NO: 18109 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (14)..(14): base is a locked nucleic acid
cargaatttgvatyccct

SEQ ID NO: 18110 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (15)..(15): base is a locked nucleic acid
cargaatttgvatyccct

SEQ ID NO: 18111 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (16)..(16): base is a locked nucleic acid
cargaatttgvatyccct

SEQ ID NO: 18112 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (12)..(12): base is a locked nucleic acid
cargaatttgvatyccct

SEQ ID NO: 18113 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (4)..(4): base is a locked nucleic acid
  modified_base (9)..(9): base is a locked nucleic acid
  modified_base (10)..(10): base is a locked nucleic acid
cargaatttgvatyccct

SEQ ID NO: 18114 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (3)..(3): base is a locked nucleic acid
  modified_base (9)..(9): base is a locked nucleic acid
  modified_base (10)..(10): base is a locked nucleic acid
cargaatttgvatyccct

SEQ ID NO: 18115 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (2)..(2): base is a locked nucleic acid
  modified_base (9)..(9): base is a locked nucleic acid
  modified_base (10)..(10): base is a locked nucleic acid
cargaatttgvatyccct

SEQ ID NO: 18116 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (10)..(10): base is a locked nucleic acid
cargaatttgvatyccct

SEQ ID NO: 18117 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
  modified_base (12)..(12): base is a locked nucleic acid
cargaatttgvatyccct

SEQ ID NO: 18118 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
  modified_base (15)..(15): base is a locked nucleic acid
cargaatttgvatyccct

SEQ ID NO: 18119 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
  modified_base (13)..(13): base is a locked nucleic acid
cargaatttgvatyccct

SEQ ID NO: 18120 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
  modified_base (17)..(17): base is a locked nucleic acid
cargaatttgvatyccct

SEQ ID NO: 18121 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (7)..(7): base is a locked nucleic acid
cargaatttgvatyccct

SEQ ID NO: 18122 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (4)..(4): base is a locked nucleic acid
cargaatttgvatyccct

SEQ ID NO: 18123 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (2)..(2): base is a locked nucleic acid
cargaatttgvatyccct

SEQ ID NO: 18124 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (18)..(18): base is a locked nucleic acid
cargaatttgvatyccct

SEQ ID NO: 18125 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (10)..(10): base is a locked nucleic acid
cargaatttgvatyccct

SEQ ID NO: 18126 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (5)..(5): base is a locked nucleic acid
  modified_base (9)..(9): base is a locked nucleic acid
  modified_base (10)..(10): base is a locked nucleic acid
cargaatttgvatyccct

SEQ ID NO: 18127 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (6)..(6): base is a locked nucleic acid
  modified_base (9)..(9): base is a locked nucleic acid
  modified_base (10)..(10): base is a locked nucleic acid
cargaatttgvatyccct

SEQ ID NO: 18128 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
  modified_base (11)..(11): base is a locked nucleic acid
cargaatttgvatyccct

SEQ ID NO: 18129 - DNA, 18 bp, Artificial Sequence
  Oligonucleotide probe
  misc_binding (1)..(18): Hybridization probe for the specific detection of mutant HIV-1 at codon 140 of the integrase gene.
  modified_base (9)..(9): base is a locked nucleic acid
  modified_base (10)..(10): base is a locked nucleic acid
  modified_base (14)..(14): base is a locked nucleic acid
cargaatttgvatyccct

SEQ ID NO: 18130 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
rgaatttgvatycccta

SEQ ID NO: 18131 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (5)..(5): base is a locked nucleic acid
rgaatttgvatycccta

SEQ ID NO: 18132 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (3)..(3): base is a locked nucleic acid
rgaatttgvatycccta

SEQ ID NO: 18133 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (6)..(6): base is a locked nucleic acid
rgaatttgvatycccta

SEQ ID NO: 18134 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
rgaatttgvatycccta

SEQ ID NO: 18135 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (15)..(15): base is a locked nucleic acid
rgaatttgvatycccta

SEQ ID NO: 18136 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (14)..(14): base is a locked nucleic acid
rgaatttgvatycccta

SEQ ID NO: 18137 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (17)..(17): base is a locked nucleic acid
rgaatttgvatycccta

SEQ ID NO: 18138 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (11)..(11): base is a locked nucleic acid
rgaatttgvatycccta

SEQ ID NO: 18139 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (4)..(4): base is a locked nucleic acid
  modified_base (8)..(8): base is a locked nucleic acid
  modified_base (9)..(9): base is a locked nucleic acid
rgaatttgvatycccta

SEQ ID NO: 18140 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (3)..(3): base is a locked nucleic acid
  modified_base (8)..(8): base is a locked nucleic acid
  modified_base (9)..(9): base is a locked nucleic acid
rgaatttgvatycccta

SEQ ID NO: 18141 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (7)..(7): base is a locked nucleic acid
  modified_base (8)..(8): base is a locked nucleic acid
  modified_base (9)..(9): base is a locked nucleic acid
rgaatttgvatycccta

SEQ ID NO: 18142 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (1)..(1): base is a locked nucleic acid
  modified_base (8)..(8): base is a locked nucleic acid
  modified_base (9)..(9): base is a locked nucleic acid
rgaatttgvatycccta

SEQ ID NO: 18143 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (13)..(13): base is a locked nucleic acid
rgaatttgvatycccta

SEQ ID NO: 18144 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (17)..(17): base is a locked nucleic acid
rgaatttgvatycccta

SEQ ID NO: 18145 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (14)..(14): base is a locked nucleic acid
rgaatttgvatycccta

SEQ ID NO: 18146 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (12)..(12): base is a locked nucleic acid
rgaatttgvatycccta

SEQ ID NO: 18147 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
argaatttgvatyccct

SEQ ID NO: 18148 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (4)..(4): base is a locked nucleic acid
argaatttgvatyccct

SEQ ID NO: 18149 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
argaatttgvatyccct

SEQ ID NO: 18150 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (2)..(2): base is a locked nucleic acid
argaatttgvatyccct

SEQ ID NO: 18151 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (7)..(7): base is a locked nucleic acid
argaatttgvatyccct

SEQ ID NO: 18152 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (13)..(13): base is a locked nucleic acid
argaatttgvatyccct

SEQ ID NO: 18153 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (14)..(14): base is a locked nucleic acid
argaatttgvatyccct

SEQ ID NO: 18154 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (15)..(15): base is a locked nucleic acid
argaatttgvatyccct

SEQ ID NO: 18155 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (11)..(11): base is a locked nucleic acid
argaatttgvatyccct

SEQ ID NO: 18156 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (3)..(3): base is a locked nucleic acid
  modified_base (8)..(8): base is a locked nucleic acid
  modified_base (9)..(9): base is a locked nucleic acid
argaatttgvatyccct

SEQ ID NO: 18157 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (2)..(2): base is a locked nucleic acid
  modified_base (8)..(8): base is a locked nucleic acid
  modified_base (9)..(9): base is a locked nucleic acid
argaatttgvatyccct

SEQ ID NO: 18158 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (1)..(1): base is a locked nucleic acid
  modified_base (8)..(8): base is a locked nucleic acid
  modified_base (9)..(9): base is a locked nucleic acid
argaatttgvatyccct

SEQ ID NO: 18159 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (7)..(7): base is a locked nucleic acid
  modified_base (8)..(8): base is a locked nucleic acid
  modified_base (9)..(9): base is a locked nucleic acid
argaatttgvatyccct

SEQ ID NO: 18160 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (11)..(11): base is a locked nucleic acid
argaatttgvatyccct

SEQ ID NO: 18161 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (14)..(14): base is a locked nucleic acid
argaatttgvatyccct

SEQ ID NO: 18162 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (12)..(12): base is a locked nucleic acid
argaatttgvatyccct

SEQ ID NO: 18163 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (16)..(16): base is a locked nucleic acid
argaatttgvatyccct

SEQ ID NO: 18164 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (6)..(6): base is a locked nucleic acid
argaatttgvatyccct

SEQ ID NO: 18165 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (3)..(3): base is a locked nucleic acid
argaatttgvatyccct

SEQ ID NO: 18166 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (1)..(1): base is a locked nucleic acid
argaatttgvatyccct

SEQ ID NO: 18167 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (17)..(17): base is a locked nucleic acid
argaatttgvatyccct

SEQ ID NO: 18168 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (9)..(9): base is a locked nucleic acid
argaatttgvatyccct

SEQ ID NO: 18169 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (4)..(4): base is a locked nucleic acid
  modified_base (8)..(8): base is a locked nucleic acid
  modified_base (9)..(9): base is a locked nucleic acid
argaatttgvatyccct

SEQ ID NO: 18170 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (5)..(5): base is a locked nucleic acid
  modified_base (8)..(8): base is a locked nucleic acid
  modified_base (9)..(9): base is a locked nucleic acid
argaatttgvatyccct

SEQ ID NO: 18171 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (10)..(10): base is a locked nucleic acid
argaatttgvatyccct

SEQ ID NO: 18172 - DNA, 17 bp, Artificial Sequence
  Oligonucleotide probe
  misc_binding (1)..(17): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (13)..(13): base is a locked nucleic acid
argaatttgvatyccct

SEQ ID NO: 18173 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
rgaatttgvatyccc

SEQ ID NO: 18174 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (5)..(5): base is a locked nucleic acid
rgaatttgvatyccc

SEQ ID NO: 18175 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (3)..(3): base is a locked nucleic acid
rgaatttgvatyccc

SEQ ID NO: 18176 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (6)..(6): base is a locked nucleic acid
rgaatttgvatyccc

SEQ ID NO: 18177 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
rgaatttgvatyccc

SEQ ID NO: 18178 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (15)..(15): base is a locked nucleic acid
rgaatttgvatyccc

SEQ ID NO: 18179 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (14)..(14): base is a locked nucleic acid
rgaatttgvatyccc

SEQ ID NO: 18180 - DNA, 16 bp, Artificial Sequence
  Oligonucleotide probe
  misc_binding (1)..(16): Hybridization probe for the specific detection of mutant HIV-1 at codon 140 of the integrase gene.
rgaatttgvatyccct

SEQ ID NO: 18181 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (11)..(11): base is a locked nucleic acid
rgaatttgvatyccc

SEQ ID NO: 18182 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (4)..(4): base is a locked nucleic acid
  modified_base (8)..(8): base is a locked nucleic acid
  modified_base (9)..(9): base is a locked nucleic acid
rgaatttgvatyccc

SEQ ID NO: 18183 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (3)..(3): base is a locked nucleic acid
  modified_base (8)..(8): base is a locked nucleic acid
  modified_base (9)..(9): base is a locked nucleic acid
rgaatttgvatyccc

SEQ ID NO: 18184 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (7)..(7): base is a locked nucleic acid
  modified_base (8)..(8): base is a locked nucleic acid
  modified_base (9)..(9): base is a locked nucleic acid
rgaatttgvatyccc

SEQ ID NO: 18185 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (1)..(1): base is a locked nucleic acid
  modified_base (8)..(8): base is a locked nucleic acid
  modified_base (9)..(9): base is a locked nucleic acid
rgaatttgvatyccc

SEQ ID NO: 18186 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (13)..(13): base is a locked nucleic acid
rgaatttgvatyccc

SEQ ID NO: 18187 - DNA, 16 bp, Artificial Sequence
  Oligonucleotide probe
  misc_binding (1)..(16): Hybridization probe for the specific detection of mutant HIV-1 at codon 140 of the integrase gene.
  modified_base (8)..(8): base is a locked nucleic acid
  modified_base (9)..(9): base is a locked nucleic acid
rgaatttgvatyccct

SEQ ID NO: 18188 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (14)..(14): base is a locked nucleic acid
rgaatttgvatyccc

SEQ ID NO: 18189 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (12)..(12): base is a locked nucleic acid
rgaatttgvatyccc

SEQ ID NO: 18190 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
argaatttgvatycc

SEQ ID NO: 18191 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (4)..(4): base is a locked nucleic acid
argaatttgvatycc

SEQ ID NO: 18192 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
argaatttgvatycc

SEQ ID NO: 18193 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (2)..(2): base is a locked nucleic acid
argaatttgvatycc

SEQ ID NO: 18194 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (7)..(7): base is a locked nucleic acid
argaatttgvatycc

SEQ ID NO: 18195 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (13)..(13): base is a locked nucleic acid
argaatttgvatycc

SEQ ID NO: 18196 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (14)..(14): base is a locked nucleic acid
argaatttgvatycc

SEQ ID NO: 18197 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (15)..(15): base is a locked nucleic acid
argaatttgvatycc

SEQ ID NO: 18198 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (11)..(11): base is a locked nucleic acid
argaatttgvatycc

SEQ ID NO: 18199 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (3)..(3): base is a locked nucleic acid
  modified_base (8)..(8): base is a locked nucleic acid
  modified_base (9)..(9): base is a locked nucleic acid
argaatttgvatycc

SEQ ID NO: 18200 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (2)..(2): base is a locked nucleic acid
  modified_base (8)..(8): base is a locked nucleic acid
  modified_base (9)..(9): base is a locked nucleic acid
argaatttgvatycc

SEQ ID NO: 18201 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (1)..(1): base is a locked nucleic acid
  modified_base (8)..(8): base is a locked nucleic acid
  modified_base (9)..(9): base is a locked nucleic acid
argaatttgvatycc

SEQ ID NO: 18202 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (7)..(7): base is a locked nucleic acid
  modified_base (8)..(8): base is a locked nucleic acid
  modified_base (9)..(9): base is a locked nucleic acid
argaatttgvatycc

SEQ ID NO: 18203 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (11)..(11): base is a locked nucleic acid
argaatttgvatycc

SEQ ID NO: 18204 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (14)..(14): base is a locked nucleic acid
argaatttgvatycc

SEQ ID NO: 18205 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (12)..(12): base is a locked nucleic acid
argaatttgvatycc

SEQ ID NO: 18206 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
argaatttgvatycc

SEQ ID NO: 18207 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (6)..(6): base is a locked nucleic acid
argaatttgvatycc

SEQ ID NO: 18208 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (3)..(3): base is a locked nucleic acid
argaatttgvatycc

SEQ ID NO: 18209 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (1)..(1): base is a locked nucleic acid
argaatttgvatycc

SEQ ID NO: 18210 - DNA, 16 bp, Artificial Sequence
  Oligonucleotide probe
  misc_binding (1)..(16): Hybridization probe for the specific detection of mutant HIV-1 at codon 140 of the integrase gene.
argaatttgvatyccc

SEQ ID NO: 18211 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (9)..(9): base is a locked nucleic acid
argaatttgvatycc

SEQ ID NO: 18212 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (4)..(4): base is a locked nucleic acid
  modified_base (8)..(8): base is a locked nucleic acid
  modified_base (9)..(9): base is a locked nucleic acid
argaatttgvatycc

SEQ ID NO: 18213 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (5)..(5): base is a locked nucleic acid
  modified_base (8)..(8): base is a locked nucleic acid
  modified_base (9)..(9): base is a locked nucleic acid
argaatttgvatycc

SEQ ID NO: 18214 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (10)..(10): base is a locked nucleic acid
argaatttgvatycc

SEQ ID NO: 18215 - DNA, 15 bp, Artificial Sequence
  Oligonucleotide probe
  misc_binding (1)..(15): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (13)..(13): base is a locked nucleic acid
argaatttgvatycc

SEQ ID NO: 18216 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
  modified_base (9)..(9): base is a locked nucleic acid
rgaatttgvatyc

SEQ ID NO: 18217 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (5)..(5): base is a locked nucleic acid
rgaatttgvatyc

SEQ ID NO: 18218 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (3)..(3): base is a locked nucleic acid
rgaatttgvatyc

SEQ ID NO: 18219 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (6)..(6): base is a locked nucleic acid
rgaatttgvatyc

SEQ ID NO: 18220 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
rgaatttgvatyc

SEQ ID NO: 18221 - DNA, 14 bp, Artificial Sequence
  Oligonucleotide probe
  misc_binding (1)..(14): Hybridization probe for the specific detection of mutant HIV-1 at codon 140 of the integrase gene.
rgaatttgvatycc

SEQ ID NO: 18222 - DNA, 13 bp, Artificial Sequence
  Oligonucleotide probe
  misc_binding (1)..(13): Hybridization probe for the specific detection of mutant HIV-1 at codon 140 of the integrase gene.
rgaatttgvatyc

SEQ ID NO: 18223 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (11)..(11): base is a locked nucleic acid
rgaatttgvatyc

SEQ ID NO: 18224 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (4)..(4): base is a locked nucleic acid
  modified_base (8)..(8): base is a locked nucleic acid
  modified_base (9)..(9): base is a locked nucleic acid
rgaatttgvatyc

SEQ ID NO: 18225 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (3)..(3): base is a locked nucleic acid
  modified_base (8)..(8): base is a locked nucleic acid
  modified_base (9)..(9): base is a locked nucleic acid
rgaatttgvatyc

SEQ ID NO: 18226 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (7)..(7): base is a locked nucleic acid
  modified_base (8)..(8): base is a locked nucleic acid
  modified_base (9)..(9): base is a locked nucleic acid
rgaatttgvatyc

SEQ ID NO: 18227 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (1)..(1): base is a locked nucleic acid
  modified_base (8)..(8): base is a locked nucleic acid
  modified_base (9)..(9): base is a locked nucleic acid
rgaatttgvatyc

SEQ ID NO: 18228 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (13)..(13): base is a locked nucleic acid
rgaatttgvatyc

SEQ ID NO: 18229 - DNA, 14 bp, Artificial Sequence
  Oligonucleotide probe
  misc_binding (1)..(14): Hybridization probe for the specific detection of mutant HIV-1 at codon 140 of the integrase gene.
  modified_base (8)..(8): base is a locked nucleic acid
  modified_base (9)..(9): base is a locked nucleic acid
rgaatttgvatycc

SEQ ID NO: 18230 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
  modified_base (9)..(9): base is a locked nucleic acid
rgaatttgvatyc

SEQ ID NO: 18231 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (12)..(12): base is a locked nucleic acid
rgaatttgvatyc

SEQ ID NO: 18232 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
  modified_base (9)..(9): base is a locked nucleic acid
argaatttgvaty

SEQ ID NO: 18233 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (4)..(4): base is a locked nucleic acid
argaatttgvaty

SEQ ID NO: 18234 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
argaatttgvaty

SEQ ID NO: 18235 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (2)..(2): base is a locked nucleic acid
argaatttgvaty

SEQ ID NO: 18236 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (7)..(7): base is a locked nucleic acid
argaatttgvaty

SEQ ID NO: 18237 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (13)..(13): base is a locked nucleic acid
argaatttgvaty

SEQ ID NO: 18238 - DNA, 13 bp, Artificial Sequence
  Oligonucleotide probe
  misc_binding (1)..(13): Hybridization probe for the specific detection of mutant HIV-1 at codon 140 of the integrase gene.
argaatttgvaty

SEQ ID NO: 18239 - DNA, 14 bp, Artificial Sequence
  Oligonucleotide probe
  misc_binding (1)..(14): Hybridization probe for the specific detection of mutant HIV-1 at codon 140 of the integrase gene.
argaatttgvatyc

SEQ ID NO: 18240 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (11)..(11): base is a locked nucleic acid
argaatttgvaty

SEQ ID NO: 18241 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (3)..(3): base is a locked nucleic acid
  modified_base (8)..(8): base is a locked nucleic acid
  modified_base (9)..(9): base is a locked nucleic acid
argaatttgvaty

SEQ ID NO: 18242 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (2)..(2): base is a locked nucleic acid
  modified_base (8)..(8): base is a locked nucleic acid
  modified_base (9)..(9): base is a locked nucleic acid
argaatttgvaty

SEQ ID NO: 18243 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (1)..(1): base is a locked nucleic acid
  modified_base (8)..(8): base is a locked nucleic acid
  modified_base (9)..(9): base is a locked nucleic acid
argaatttgvaty

SEQ ID NO: 18244 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (7)..(7): base is a locked nucleic acid
  modified_base (8)..(8): base is a locked nucleic acid
  modified_base (9)..(9): base is a locked nucleic acid
argaatttgvaty

SEQ ID NO: 18245 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (11)..(11): base is a locked nucleic acid
argaatttgvaty

SEQ ID NO: 18246 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
  modified_base (9)..(9): base is a locked nucleic acid
argaatttgvaty

SEQ ID NO: 18247 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (12)..(12): base is a locked nucleic acid
argaatttgvaty

SEQ ID NO: 18248 - DNA, 14 bp, Artificial Sequence
  Oligonucleotide probe
  misc_binding (1)..(14): Hybridization probe for the specific detection of mutant HIV-1 at codon 140 of the integrase gene.
  modified_base (8)..(8): base is a locked nucleic acid
  modified_base (9)..(9): base is a locked nucleic acid
argaatttgvatyc

SEQ ID NO: 18249 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (6)..(6): base is a locked nucleic acid
argaatttgvaty

SEQ ID NO: 18250 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (3)..(3): base is a locked nucleic acid
argaatttgvaty

SEQ ID NO: 18251 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (1)..(1): base is a locked nucleic acid
argaatttgvaty

SEQ ID NO: 18252 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (9)..(9): base is a locked nucleic acid
argaatttgvaty

SEQ ID NO: 18253 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (4)..(4): base is a locked nucleic acid
  modified_base (8)..(8): base is a locked nucleic acid
  modified_base (9)..(9): base is a locked nucleic acid
argaatttgvaty

SEQ ID NO: 18254 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (5)..(5): base is a locked nucleic acid
  modified_base (8)..(8): base is a locked nucleic acid
  modified_base (9)..(9): base is a locked nucleic acid
argaatttgvaty

SEQ ID NO: 18255 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (10)..(10): base is a locked nucleic acid
argaatttgvaty

SEQ ID NO: 18256 - DNA, 13 bp, Artificial Sequence
  Oligonucleotide probe
  misc_binding (1)..(13): Hybridization probe for the specific detection of mutant HIV-1 at codon 140 of the integrase gene.
  modified_base (8)..(8): base is a locked nucleic acid
  modified_base (9)..(9): base is a locked nucleic acid
  modified_base (13)..(13): base is a locked nucleic acid
argaatttgvaty

SEQ ID NO: 18257 - DNA, 18 bp, Artificial Sequence
  Oligonucleotide probe
  misc_binding (1)..(18): Hybridization probe for the specific detection of mutant HIV-1 at codon 140 of the integrase gene.
argaatttgvatycccta

SEQ ID NO: 18258 - DNA, 18 bp, Artificial Sequence
  Oligonucleotide probe
  misc_binding (1)..(18): Hybridization probe for the specific detection of mutant HIV-1 at codon 140 of the integrase gene.
cargaatttgvatyccct

SEQ ID NO: 18259 - DNA, 17 bp, Artificial Sequence
  Oligonucleotide probe
  misc_binding (1)..(17): Hybridization probe for the specific detection of mutant HIV-1 at codon 140 of the integrase gene.
rgaatttgvatycccta

SEQ ID NO: 18260 - DNA, 17 bp, Artificial Sequence
  Oligonucleotide probe
  misc_binding (1)..(17): Hybridization probe for the specific detection of mutant HIV-1 at codon 140 of the integrase gene.
argaatttgvatyccct

SEQ ID NO: 18261 - DNA, 15 bp, Artificial Sequence
  Oligonucleotide probe
  misc_binding (1)..(15): Hybridization probe for the specific detection of mutant HIV-1 at codon 140 of the integrase gene.
rgaatttgvatyccc

SEQ ID NO: 18262 - DNA, 15 bp, Artificial Sequence
  Oligonucleotide probe
  misc_binding (1)..(15): Hybridization probe for the specific detection of mutant HIV-1 at codon 140 of the integrase gene.
argaatttgvatycc

SEQ ID NO: 18263 - DNA, 13 bp, Artificial Sequence
  Oligonucleotide probe
  misc_binding (1)..(13): Hybridization probe for the specific detection of mutant HIV-1 at codon 140 of the integrase gene.
rgaatttgvatyc

SEQ ID NO: 18264 - DNA, 13 bp, Artificial Sequence
  Oligonucleotide probe
  misc_binding (1)..(13): Hybridization probe for the specific detection of mutant HIV-1 at codon 140 of the integrase gene.
argaatttgvaty

SEQ ID NO: 18265 - DNA, 15 bp, Artificial Sequence
  Oligonucleotide probe
  misc_binding (1)..(15): Hybridization probe for the specific detection of mutant HIV-1 at codon 140 of the integrase gene.
aatttagyattccct

SEQ ID NO: 18266 - DNA, 15 bp, Artificial Sequence
  Oligonucleotide probe
  misc_binding (1)..(15): Hybridization probe for the specific detection of mutant HIV-1 at codon 140 of the integrase gene.
  misc_feature (8)..(8): n is a, c, g, or t
aatttgcnattccct

SEQ ID NO: 18267 - DNA, 15 bp, Artificial Sequence
  Oligonucleotide probe
  misc_binding (1)..(15): Hybridization probe for the specific detection of mutant HIV-1 at codon 140 of the integrase gene.
aattttgyattccct

SEQ ID NO: 18268 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
gvatyccctcaatcccca

SEQ ID NO: 18269 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (5)..(5): base is a locked nucleic acid
gvatyccctcaatcccca

SEQ ID NO: 18270 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (3)..(3): base is a locked nucleic acid
gvatyccctcaatcccca

SEQ ID NO: 18271 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (6)..(6): base is a locked nucleic acid
gvatyccctcaatcccca

SEQ ID NO: 18272 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
gvatyccctcaatcccca

SEQ ID NO: 18273 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (15)..(15): base is a locked nucleic acid
gvatyccctcaatcccca

SEQ ID NO: 18274 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (16)..(16): base is a locked nucleic acid
gvatyccctcaatcccca

SEQ ID NO: 18275 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (11)..(11): base is a locked nucleic acid
gvatyccctcaatcccca

SEQ ID NO: 18276 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (14)..(14): base is a locked nucleic acid
gvatyccctcaatcccca

SEQ ID NO: 18277 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (3)..(3): base is a locked nucleic acid
  modified_base (9)..(9): base is a locked nucleic acid
  modified_base (10)..(10): base is a locked nucleic acid
gvatyccctcaatcccca

SEQ ID NO: 18278 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (7)..(7): base is a locked nucleic acid
  modified_base (9)..(9): base is a locked nucleic acid
  modified_base (10)..(10): base is a locked nucleic acid
gvatyccctcaatcccca

SEQ ID NO: 18279 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (2)..(2): base is a locked nucleic acid
  modified_base (9)..(9): base is a locked nucleic acid
  modified_base (10)..(10): base is a locked nucleic acid
gvatyccctcaatcccca

SEQ ID NO: 18280 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (6)..(6): base is a locked nucleic acid
  modified_base (9)..(9): base is a locked nucleic acid
  modified_base (10)..(10): base is a locked nucleic acid
gvatyccctcaatcccca

SEQ ID NO: 18281 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
  modified_base (17)..(17): base is a locked nucleic acid
gvatyccctcaatcccca

SEQ ID NO: 18282 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
  modified_base (13)..(13): base is a locked nucleic acid
gvatyccctcaatcccca

SEQ ID NO: 18283 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
  modified_base (18)..(18): base is a locked nucleic acid
gvatyccctcaatcccca

SEQ ID NO: 18284 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
  modified_base (11)..(11): base is a locked nucleic acid
gvatyccctcaatcccca

SEQ ID NO: 18285 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
ggvatycccacaatcccc

SEQ ID NO: 18286 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (2)..(2): base is a locked nucleic acid
ggvatycccacaatcccc

SEQ ID NO: 18287 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (3)..(3): base is a locked nucleic acid
ggvatycccacaatcccc

SEQ ID NO: 18288 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
ggvatycccacaatcccc

SEQ ID NO: 18289 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (5)..(5): base is a locked nucleic acid
ggvatycccacaatcccc

SEQ ID NO: 18290 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (14)..(14): base is a locked nucleic acid
ggvatycccacaatcccc

SEQ ID NO: 18291 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (18)..(18): base is a locked nucleic acid
ggvatycccacaatcccc

SEQ ID NO: 18292 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (11)..(11): base is a locked nucleic acid
ggvatycccacaatcccc

SEQ ID NO: 18293 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (12)..(12): base is a locked nucleic acid
ggvatycccacaatcccc

SEQ ID NO: 18294 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (7)..(7): base is a locked nucleic acid
  modified_base (9)..(9): base is a locked nucleic acid
  modified_base (10)..(10): base is a locked nucleic acid
ggvatycccacaatcccc

SEQ ID NO: 18295 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (6)..(6): base is a locked nucleic acid
  modified_base (9)..(9): base is a locked nucleic acid
  modified_base (10)..(10): base is a locked nucleic acid
ggvatycccacaatcccc

SEQ ID NO: 18296 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (3)..(3): base is a locked nucleic acid
  modified_base (9)..(9): base is a locked nucleic acid
  modified_base (10)..(10): base is a locked nucleic acid
ggvatycccacaatcccc

SEQ ID NO: 18297 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (5)..(5): base is a locked nucleic acid
  modified_base (9)..(9): base is a locked nucleic acid
  modified_base (10)..(10): base is a locked nucleic acid
ggvatycccacaatcccc

SEQ ID NO: 18298 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
  modified_base (16)..(16): base is a locked nucleic acid
ggvatycccacaatcccc

SEQ ID NO: 18299 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
  modified_base (11)..(11): base is a locked nucleic acid
ggvatycccacaatcccc

SEQ ID NO: 18300 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
  modified_base (14)..(14): base is a locked nucleic acid
ggvatycccacaatcccc

SEQ ID NO: 18301 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
  modified_base (18)..(18): base is a locked nucleic acid
ggvatycccacaatcccc

SEQ ID NO: 18302 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (2)..(2): base is a locked nucleic acid
gvatyccctcaatcccca

SEQ ID NO: 18303 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (4)..(4): base is a locked nucleic acid
gvatyccctcaatcccca

SEQ ID NO: 18304 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (18)..(18): base is a locked nucleic acid
gvatyccctcaatcccca

SEQ ID NO: 18305 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (12)..(12): base is a locked nucleic acid
gvatyccctcaatcccca

SEQ ID NO: 18306 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (10)..(10): base is a locked nucleic acid
gvatyccctcaatcccca

SEQ ID NO: 18307 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
  modified_base (14)..(14): base is a locked nucleic acid
gvatyccctcaatcccca

SEQ ID NO: 18308 - DNA, 18 bp, Artificial Sequence
  Oligonucleotide probe
  misc_binding (1)..(18): Hybridization probe for the specific detection of mutant HIV-1 at codon 143 of the integrase gene.
  modified_base (9)..(9): base is a locked nucleic acid
  modified_base (10)..(10): base is a locked nucleic acid
  modified_base (12)..(12): base is a locked nucleic acid
gvatyccctcaatcccca

SEQ ID NO: 18309 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
vatyccctcaatcccca

SEQ ID NO: 18310 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (4)..(4): base is a locked nucleic acid
vatyccctcaatcccca

SEQ ID NO: 18311 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (2)..(2): base is a locked nucleic acid
vatyccctcaatcccca

SEQ ID NO: 18312 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (5)..(5): base is a locked nucleic acid
vatyccctcaatcccca

SEQ ID NO: 18313 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
vatyccctcaatcccca

SEQ ID NO: 18314 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (14)..(14): base is a locked nucleic acid
vatyccctcaatcccca

SEQ ID NO: 18315 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (15)..(15): base is a locked nucleic acid
vatyccctcaatcccca

SEQ ID NO: 18316 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (10)..(10): base is a locked nucleic acid
vatyccctcaatcccca

SEQ ID NO: 18317 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (13)..(13): base is a locked nucleic acid
vatyccctcaatcccca

SEQ ID NO: 18318 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (2)..(2): base is a locked nucleic acid
  modified_base (8)..(8): base is a locked nucleic acid
  modified_base (9)..(9): base is a locked nucleic acid
vatyccctcaatcccca

SEQ ID NO: 18319 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (6)..(6): base is a locked nucleic acid
  modified_base (8)..(8): base is a locked nucleic acid
  modified_base (9)..(9): base is a locked nucleic acid
vatyccctcaatcccca

SEQ ID NO: 18320 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (1)..(1): base is a locked nucleic acid
  modified_base (8)..(8): base is a locked nucleic acid
  modified_base (9)..(9): base is a locked nucleic acid
vatyccctcaatcccca

SEQ ID NO: 18321 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (5)..(5): base is a locked nucleic acid
  modified_base (8)..(8): base is a locked nucleic acid
  modified_base (9)..(9): base is a locked nucleic acid
vatyccctcaatcccca

SEQ ID NO: 18322 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (16)..(16): base is a locked nucleic acid
vatyccctcaatcccca

SEQ ID NO: 18323 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (12)..(12): base is a locked nucleic acid
vatyccctcaatcccca

SEQ ID NO: 18324 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (17)..(17): base is a locked nucleic acid
vatyccctcaatcccca

SEQ ID NO: 18325 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (10)..(10): base is a locked nucleic acid
vatyccctcaatcccca

SEQ ID NO: 18326 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
gvatycccacaatcccc

SEQ ID NO: 18327 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (1)..(1): base is a locked nucleic acid
gvatycccacaatcccc

SEQ ID NO: 18328 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (2)..(2): base is a locked nucleic acid
gvatycccacaatcccc

SEQ ID NO: 18329 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
gvatycccacaatcccc

SEQ ID NO: 18330 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (4)..(4): base is a locked nucleic acid
gvatycccacaatcccc

SEQ ID NO: 18331 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (13)..(13): base is a locked nucleic acid
gvatycccacaatcccc

SEQ ID NO: 18332 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (17)..(17): base is a locked nucleic acid
gvatycccacaatcccc

SEQ ID NO: 18333 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (10)..(10): base is a locked nucleic acid
gvatycccacaatcccc

SEQ ID NO: 18334 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (11)..(11): base is a locked nucleic acid
gvatycccacaatcccc

SEQ ID NO: 18335 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (6)..(6): base is a locked nucleic acid
  modified_base (8)..(8): base is a locked nucleic acid
  modified_base (9)..(9): base is a locked nucleic acid
gvatycccacaatcccc

SEQ ID NO: 18336 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (5)..(5): base is a locked nucleic acid
  modified_base (8)..(8): base is a locked nucleic acid
  modified_base (9)..(9): base is a locked nucleic acid
gvatycccacaatcccc

SEQ ID NO: 18337 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (2)..(2): base is a locked nucleic acid
  modified_base (8)..(8): base is a locked nucleic acid
  modified_base (9)..(9): base is a locked nucleic acid
gvatycccacaatcccc

SEQ ID NO: 18338 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (4)..(4): base is a locked nucleic acid
  modified_base (8)..(8): base is a locked nucleic acid
  modified_base (9)..(9): base is a locked nucleic acid
gvatycccacaatcccc

SEQ ID NO: 18339 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (15)..(15): base is a locked nucleic acid
gvatycccacaatcccc

SEQ ID NO: 18340 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (10)..(10): base is a locked nucleic acid
gvatycccacaatcccc

SEQ ID NO: 18341 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (13)..(13): base is a locked nucleic acid
gvatycccacaatcccc

SEQ ID NO: 18342 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (17)..(17): base is a locked nucleic acid
gvatycccacaatcccc

SEQ ID NO: 18343 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (1)..(1): base is a locked nucleic acid
vatyccctcaatcccca

SEQ ID NO: 18344 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (3)..(3): base is a locked nucleic acid
vatyccctcaatcccca

SEQ ID NO: 18345 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (17)..(17): base is a locked nucleic acid
vatyccctcaatcccca

SEQ ID NO: 18346 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (11)..(11): base is a locked nucleic acid
vatyccctcaatcccca

SEQ ID NO: 18347 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (7)..(7): base is a locked nucleic acid
  modified_base (8)..(8): base is a locked nucleic acid
  modified_base (9)..(9): base is a locked nucleic acid
vatyccctcaatcccca

SEQ ID NO: 18348 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (13)..(13): base is a locked nucleic acid
vatyccctcaatcccca

SEQ ID NO: 18349 - DNA, 17 bp, Artificial Sequence
  Oligonucleotide probe
  misc_binding (1)..(17): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (11)..(11): base is a locked nucleic acid
vatyccctcaatcccca

SEQ ID NO: 18350 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
  modified_base (9)..(9): base is a locked nucleic acid
vatyccctcaatccc

SEQ ID NO: 18351 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (4)..(4): base is a locked nucleic acid
vatyccctcaatccc

SEQ ID NO: 18352 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (2)..(2): base is a locked nucleic acid
vatyccctcaatccc

SEQ ID NO: 18353 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (5)..(5): base is a locked nucleic acid
vatyccctcaatccc

SEQ ID NO: 18354 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
vatyccctcaatccc

SEQ ID NO: 18355 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (14)..(14): base is a locked nucleic acid
vatyccctcaatccc

SEQ ID NO: 18356 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (15)..(15): base is a locked nucleic acid
vatyccctcaatccc

SEQ ID NO: 18357 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (10)..(10): base is a locked nucleic acid
vatyccctcaatccc

SEQ ID NO: 18358 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (13)..(13): base is a locked nucleic acid
vatyccctcaatccc

SEQ ID NO: 18359 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (2)..(2): base is a locked nucleic acid
  modified_base (8)..(8): base is a locked nucleic acid
  modified_base (9)..(9): base is a locked nucleic acid
vatyccctcaatccc

SEQ ID NO: 18360 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (6)..(6): base is a locked nucleic acid
  modified_base (8)..(8): base is a locked nucleic acid
  modified_base (9)..(9): base is a locked nucleic acid
vatyccctcaatccc

SEQ ID NO: 18361 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (1)..(1): base is a locked nucleic acid
  modified_base (8)..(8): base is a locked nucleic acid
  modified_base (9)..(9): base is a locked nucleic acid
vatyccctcaatccc

SEQ ID NO: 18362 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (5)..(5): base is a locked nucleic acid
  modified_base (8)..(8): base is a locked nucleic acid
  modified_base (9)..(9): base is a locked nucleic acid
vatyccctcaatccc

SEQ ID NO: 18363 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
  modified_base (9)..(9): base is a locked nucleic acid
vatyccctcaatccc

SEQ ID NO: 18364 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (12)..(12): base is a locked nucleic acid
vatyccctcaatccc

SEQ ID NO: 18365 - DNA, 16 bp, Artificial Sequence
  Oligonucleotide probe
  misc_binding (1)..(16): Hybridization probe for the specific detection of mutant HIV-1 at codon 143 of the integrase gene.
  modified_base (8)..(8): base is a locked nucleic acid
  modified_base (9)..(9): base is a locked nucleic acid
vatyccctcaatcccc

SEQ ID NO: 18366 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (10)..(10): base is a locked nucleic acid
vatyccctcaatccc

SEQ ID NO: 18367 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
  modified_base (9)..(9): base is a locked nucleic acid
gvatycccacaatcc

SEQ ID NO: 18368 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (1)..(1): base is a locked nucleic acid
gvatycccacaatcc

SEQ ID NO: 18369 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (2)..(2): base is a locked nucleic acid
gvatycccacaatcc

SEQ ID NO: 18370 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
gvatycccacaatcc

SEQ ID NO: 18371 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (4)..(4): base is a locked nucleic acid
gvatycccacaatcc

SEQ ID NO: 18372 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (13)..(13): base is a locked nucleic acid
gvatycccacaatcc

SEQ ID NO: 18373 - DNA, 16 bp, Artificial Sequence
  Oligonucleotide probe
  misc_binding (1)..(16): Hybridization probe for the specific detection of mutant HIV-1 at codon 143 of the integrase gene.
gvatycccacaatccc

SEQ ID NO: 18374 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (10)..(10): base is a locked nucleic acid
gvatycccacaatcc

SEQ ID NO: 18375 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (11)..(11): base is a locked nucleic acid
gvatycccacaatcc

SEQ ID NO: 18376 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (6)..(6): base is a locked nucleic acid
  modified_base (8)..(8): base is a locked nucleic acid
  modified_base (9)..(9): base is a locked nucleic acid
gvatycccacaatcc

SEQ ID NO: 18377 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (5)..(5): base is a locked nucleic acid
  modified_base (8)..(8): base is a locked nucleic acid
  modified_base (9)..(9): base is a locked nucleic acid
gvatycccacaatcc

SEQ ID NO: 18378 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (2)..(2): base is a locked nucleic acid
  modified_base (8)..(8): base is a locked nucleic acid
  modified_base (9)..(9): base is a locked nucleic acid
gvatycccacaatcc

SEQ ID NO: 18379 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (4)..(4): base is a locked nucleic acid
  modified_base (8)..(8): base is a locked nucleic acid
  modified_base (9)..(9): base is a locked nucleic acid
gvatycccacaatcc

SEQ ID NO: 18380 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (15)..(15): base is a locked nucleic acid
gvatycccacaatcc

SEQ ID NO: 18381 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (10)..(10): base is a locked nucleic acid
gvatycccacaatcc

SEQ ID NO: 18382 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (13)..(13): base is a locked nucleic acid
gvatycccacaatcc

SEQ ID NO: 18383 - DNA, 16 bp, Artificial Sequence
  Oligonucleotide probe
  misc_binding (1)..(16): Hybridization probe for the specific detection of mutant HIV-1 at codon 143 of the integrase gene.
  modified_base (8)..(8): base is a locked nucleic acid
  modified_base (9)..(9): base is a locked nucleic acid
gvatycccacaatccc

SEQ ID NO: 18384 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (1)..(1): base is a locked nucleic acid
vatyccctcaatccc

SEQ ID NO: 18385 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (3)..(3): base is a locked nucleic acid
vatyccctcaatccc

SEQ ID NO: 18386 - DNA, 16 bp, Artificial Sequence
  Oligonucleotide probe
  misc_binding (1)..(16): Hybridization probe for the specific detection of mutant HIV-1 at codon 143 of the integrase gene.
vatyccctcaatcccc

SEQ ID NO: 18387 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (11)..(11): base is a locked nucleic acid
vatyccctcaatccc

SEQ ID NO: 18388 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (7)..(7): base is a locked nucleic acid
  modified_base (8)..(8): base is a locked nucleic acid
  modified_base (9)..(9): base is a locked nucleic acid
vatyccctcaatccc

SEQ ID NO: 18389 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (13)..(13): base is a locked nucleic acid
vatyccctcaatccc

SEQ ID NO: 18390 - DNA, 15 bp, Artificial Sequence
  Oligonucleotide probe
  misc_binding (1)..(15): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (11)..(11): base is a locked nucleic acid
vatyccctcaatccc

SEQ ID NO: 18391 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (8)..(8): base is a locked nucleic acid
  modified_base (9)..(9): base is a locked nucleic acid
vatyccctcaatc

SEQ ID NO: 18392 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (4)..(4): base is a locked nucleic acid
vatyccctcaatc

SEQ ID NO: 18393 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (2)..(2): base is a locked nucleic acid
vatyccctcaatc

SEQ ID NO: 18394 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (5)..(5): base is a locked nucleic acid
vatyccctcaatc

SEQ ID NO: 18395 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (8)..(8): base is a locked nucleic acid
vatyccctcaatc

SEQ ID NO: 18396 - DNA, 13 bp, Artificial Sequence
  Oligonucleotide probe
  misc_binding (1)..(13): Hybridization probe for the specific detection of mutant HIV-1 at codon 143 of the integrase gene.
vatyccctcaatc

SEQ ID NO: 18397 - DNA, 14 bp, Artificial Sequence
  Oligonucleotide probe
  misc_binding (1)..(14): Hybridization probe for the specific detection of mutant HIV-1 at codon 143 of the integrase gene.
vatyccctcaatcc

SEQ ID NO: 18398 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (10)..(10): base is a locked nucleic acid
vatyccctcaatc

SEQ ID NO: 18399 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (13)..(13): base is a locked nucleic acid
vatyccctcaatc

SEQ ID NO: 18400 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (2)..(2): base is a locked nucleic acid
  modified_base (8)..(8): base is a locked nucleic acid
  modified_base (9)..(9): base is a locked nucleic acid
vatyccctcaatc

SEQ ID NO: 18401 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (6)..(6): base is a locked nucleic acid
  modified_base (8)..(8): base is a locked nucleic acid
  modified_base (9)..(9): base is a locked nucleic acid
vatyccctcaatc

SEQ ID NO: 18402 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (1)..(1): base is a locked nucleic acid
  modified_base (8)..(8): base is a locked nucleic acid
  modified_base (9)..(9): base is a locked nucleic acid
vatyccctcaatc

SEQ ID NO: 18403 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (5)..(5): base is a locked nucleic acid
  modified_base (8)..(8): base is a locked nucleic acid
  modified_base (9)..(9): base is a locked nucleic acid
vatyccctcaatc

SEQ ID NO: 18404 - DNA, 14 bp, Artificial Sequence
  Oligonucleotide probe
  misc_binding (1)..(14): Hybridization probe for the specific detection of mutant HIV-1 at codon 143 of the integrase gene.
  modified_base (8)..(8): base is a locked nucleic acid
  modified_base (9)..(9): base is a locked nucleic acid
vatyccctcaatcc

SEQ ID NO: 18405 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (12)..(12): base is a locked nucleic acid
vatyccctcaatc

SEQ ID NO: 18406 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (10)..(10): base is a locked nucleic acid
vatyccctcaatc

SEQ ID NO: 18407 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (8)..(8): base is a locked nucleic acid
  modified_base (9)..(9): base is a locked nucleic acid
gvatycccacaat

SEQ ID NO: 18408 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (1)..(1): base is a locked nucleic acid
gvatycccacaat

SEQ ID NO: 18409 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (2)..(2): base is a locked nucleic acid
gvatycccacaat

SEQ ID NO: 18410 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (8)..(8): base is a locked nucleic acid
gvatycccacaat

SEQ ID NO: 18411 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (4)..(4): base is a locked nucleic acid
gvatycccacaat

SEQ ID NO: 18412 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (13)..(13): base is a locked nucleic acid
gvatycccacaat

SEQ ID NO: 18413 - DNA, 14 bp, Artificial Sequence
  Oligonucleotide probe
  misc_binding (1)..(14): Hybridization probe for the specific detection of mutant HIV-1 at codon 143 of the integrase gene.
gvatycccacaatc

SEQ ID NO: 18414 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (10)..(10): base is a locked nucleic acid
gvatycccacaat

SEQ ID NO: 18415 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (11)..(11): base is a locked nucleic acid
gvatycccacaat

SEQ ID NO: 18416 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (6)..(6): base is a locked nucleic acid
  modified_base (8)..(8): base is a locked nucleic acid
  modified_base (9)..(9): base is a locked nucleic acid
gvatycccacaat

SEQ ID NO: 18417 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (5)..(5): base is a locked nucleic acid
  modified_base (8)..(8): base is a locked nucleic acid
  modified_base (9)..(9): base is a locked nucleic acid
gvatycccacaat

SEQ ID NO: 18418 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (2)..(2): base is a locked nucleic acid
  modified_base (8)..(8): base is a locked nucleic acid
  modified_base (9)..(9): base is a locked nucleic acid
gvatycccacaat

SEQ ID NO: 18419 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (4)..(4): base is a locked nucleic acid
  modified_base (8)..(8): base is a locked nucleic acid
  modified_base (9)..(9): base is a locked nucleic acid
gvatycccacaat

SEQ ID NO: 18420 - DNA, 14 bp, Artificial Sequence
  Oligonucleotide probe
  misc_binding (1)..(14): Hybridization probe for the specific detection of mutant HIV-1 at codon 143 of the integrase gene.
  modified_base (8)..(8): base is a locked nucleic acid
  modified_base (9)..(9): base is a locked nucleic acid
gvatycccacaatc

SEQ ID NO: 18421 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (10)..(10): base is a locked nucleic acid
gvatycccacaat

SEQ ID NO: 18422 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (13)..(13): base is a locked nucleic acid
gvatycccacaat

SEQ ID NO: 18423 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (1)..(1): base is a locked nucleic acid
vatyccctcaatc

SEQ ID NO: 18424 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (3)..(3): base is a locked nucleic acid
vatyccctcaatc

SEQ ID NO: 18425 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (11)..(11): base is a locked nucleic acid
vatyccctcaatc

SEQ ID NO: 18426 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (7)..(7): base is a locked nucleic acid
  modified_base (8)..(8): base is a locked nucleic acid
  modified_base (9)..(9): base is a locked nucleic acid
vatyccctcaatc

SEQ ID NO: 18427 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (13)..(13): base is a locked nucleic acid
vatyccctcaatc

SEQ ID NO: 18428 - DNA, 13 bp, Artificial Sequence
  Oligonucleotide probe
  misc_binding (1)..(13): Hybridization probe for the specific detection of mutant HIV-1 at codon 143 of the integrase gene.
  modified_base (8)..(8): base is a locked nucleic acid
  modified_base (9)..(9): base is a locked nucleic acid
  modified_base (11)..(11): base is a locked nucleic acid
vatyccctcaatc

SEQ ID NO: 18429 - DNA, 18 bp, Artificial Sequence
  Oligonucleotide probe
  misc_binding (1)..(18): Hybridization probe for the specific detection of mutant HIV-1 at codon 143 of the integrase gene.
gvatyccctcaatcccca

SEQ ID NO: 18430 - DNA, 18 bp, Artificial Sequence
  Oligonucleotide probe
  misc_binding (1)..(18): Hybridization probe for the specific detection of mutant HIV-1 at codon 143 of the integrase gene.
ggvatycccacaatcccc

SEQ ID NO: 18431 - DNA, 17 bp, Artificial Sequence
  Oligonucleotide probe
  misc_binding (1)..(17): Hybridization probe for the specific detection of mutant HIV-1 at codon 143 of the integrase gene.
vatyccctcaatcccca

SEQ ID NO: 18432 - DNA, 17 bp, Artificial Sequence
  Oligonucleotide probe
  misc_binding (1)..(17): Hybridization probe for the specific detection of mutant HIV-1 at codon 143 of the integrase gene.
gvatycccacaatcccc

SEQ ID NO: 18433 - DNA, 15 bp, Artificial Sequence
  Oligonucleotide probe
  misc_binding (1)..(15): Hybridization probe for the specific detection of mutant HIV-1 at codon 143 of the integrase gene.
vatyccctcaatccc

SEQ ID NO: 18434 - DNA, 15 bp, Artificial Sequence
  Oligonucleotide probe
  misc_binding (1)..(15): Hybridization probe for the specific detection of mutant HIV-1 at codon 143 of the integrase gene.
gvatycccacaatcc

SEQ ID NO: 18435 - DNA, 13 bp, Artificial Sequence
  Oligonucleotide probe
  misc_binding (1)..(13): Hybridization probe for the specific detection of mutant HIV-1 at codon 143 of the integrase gene.
vatyccctcaatc

SEQ ID NO: 18436 - DNA, 13 bp, Artificial Sequence
  Oligonucleotide probe
  misc_binding (1)..(13): Hybridization probe for the specific detection of mutant HIV-1 at codon 143 of the integrase gene.
gvatycccacaat

SEQ ID NO: 18437 - DNA, 15 bp, Artificial Sequence
  Oligonucleotide probe
  misc_binding (1)..(15): Hybridization probe for the specific detection of mutant HIV-1 at codon 143 of the integrase gene.
attccctgyaatccc

SEQ ID NO: 18438 - DNA, 15 bp, Artificial Sequence
  Oligonucleotide probe
  misc_binding (1)..(15): Hybridization probe for the specific detection of mutant HIV-1 at codon 143 of the integrase gene.
attccccgyaatccc

SEQ ID NO: 18439 - DNA, 15 bp, Artificial Sequence
  Oligonucleotide probe
  misc_binding (1)..(15): Hybridization probe for the specific detection of mutant HIV-1 at codon 143 of the integrase gene.
attcccagraatccc

SEQ ID NO: 18440 - DNA, 15 bp, Artificial Sequence
  Oligonucleotide probe
  misc_binding (1)..(15): Hybridization probe for the specific detection of mutant HIV-1 at codon 143 of the integrase gene.
attccccayaatccc

SEQ ID NO: 18441 - DNA, 15 bp, Artificial Sequence
  Oligonucleotide probe
  misc_binding (1)..(15): Hybridization probe for the specific detection of mutant HIV-1 at codon 143 of the integrase gene.
attcccaaraatccc

SEQ ID NO: 18442 - DNA, 15 bp, Artificial Sequence
  Oligonucleotide probe
  misc_binding (1)..(15): Hybridization probe for the specific detection of mutant HIV-1 at codon 143 of the integrase gene.
attcccagyaatccc

SEQ ID NO: 18443 - DNA, 15 bp, Artificial Sequence
  Oligonucleotide probe
  misc_binding (1)..(15): Hybridization probe for the specific detection of mutant HIV-1 at codon 143 of the integrase gene.
attcccggyaatccc

SEQ ID NO: 18444 - DNA, 15 bp, Artificial Sequence
  Oligonucleotide probe
  misc_binding (1)..(15): Hybridization probe for the specific detection of mutant HIV-1 at codon 143 of the integrase gene.
attcccgcyaatccc

SEQ ID NO: 18445 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (9)..(9): base is a locked nucleic acid
  modified_base (10)..(10): base is a locked nucleic acid
ccctacaatcccaaagyc

SEQ ID NO: 18446 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (2)..(2): base is a locked nucleic acid
ccctacaatcccaaagyc

SEQ ID NO: 18447 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (3)..(3): base is a locked nucleic acid
ccctacaatcccaaagyc

SEQ ID NO: 18448 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (9)..(9): base is a locked nucleic acid
ccctacaatcccaaagyc

SEQ ID NO: 18449 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (4)..(4): base is a locked nucleic acid
ccctacaatcccaaagyc

SEQ ID NO: 18450 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (18)..(18): base is a locked nucleic acid
ccctacaatcccaaagyc

SEQ ID NO: 18451 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (14)..(14): base is a locked nucleic acid
ccctacaatcccaaagyc

SEQ ID NO: 18452 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (13)..(13): base is a locked nucleic acid
ccctacaatcccaaagyc

SEQ ID NO: 18453 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (15)..(15): base is a locked nucleic acid
ccctacaatcccaaagyc

SEQ ID NO: 18454 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (3)..(3): base is a locked nucleic acid
  modified_base (9)..(9): base is a locked nucleic acid
  modified_base (10)..(10): base is a locked nucleic acid
ccctacaatcccaaagyc

SEQ ID NO: 18455 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (4)..(4): base is a locked nucleic acid
  modified_base (9)..(9): base is a locked nucleic acid
  modified_base (10)..(10): base is a locked nucleic acid
ccctacaatcccaaagyc

SEQ ID NO: 18456 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (8)..(8): base is a locked nucleic acid
  modified_base (9)..(9): base is a locked nucleic acid
  modified_base (10)..(10): base is a locked nucleic acid
ccctacaatcccaaagyc

SEQ ID NO: 18457 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (6)..(6): base is a locked nucleic acid
  modified_base (9)..(9): base is a locked nucleic acid
  modified_base (10)..(10): base is a locked nucleic acid
ccctacaatcccaaagyc

SEQ ID NO: 18458 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (9)..(9): base is a locked nucleic acid
  modified_base (10)..(10): base is a locked nucleic acid
  modified_base (15)..(15): base is a locked nucleic acid
ccctacaatcccaaagyc

SEQ ID NO: 18459 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (9)..(9): base is a locked nucleic acid
  modified_base (10)..(10): base is a locked nucleic acid
  modified_base (11)..(11): base is a locked nucleic acid
ccctacaatcccaaagyc

SEQ ID NO: 18460 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (9)..(9): base is a locked nucleic acid
  modified_base (10)..(10): base is a locked nucleic acid
  modified_base (14)..(14): base is a locked nucleic acid
ccctacaatcccaaagyc

SEQ ID NO: 18461 - DNA, 18 bp, Artificial Sequence
  Oligonucleotide probe
  misc_binding (1)..(18): Hybridization probe for the specific detection of mutant HIV-1 at codon 145 of the integrase gene.
  modified_base (9)..(9): base is a locked nucleic acid
  modified_base (10)..(10): base is a locked nucleic acid
  modified_base (18)..(18): base is a locked nucleic acid
ccctacaatcccaaagyc

SEQ ID NO: 18462 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (8)..(8): base is a locked nucleic acid
  modified_base (9)..(9): base is a locked nucleic acid
cctacaatcccaaagyc

SEQ ID NO: 18463 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (1)..(1): base is a locked nucleic acid
cctacaatcccaaagyc

SEQ ID NO: 18464 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (2)..(2): base is a locked nucleic acid
cctacaatcccaaagyc

SEQ ID NO: 18465 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (8)..(8): base is a locked nucleic acid
cctacaatcccaaagyc

SEQ ID NO: 18466 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (3)..(3): base is a locked nucleic acid
cctacaatcccaaagyc

SEQ ID NO: 18467 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (17)..(17): base is a locked nucleic acid
cctacaatcccaaagyc

SEQ ID NO: 18468 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (13)..(13): base is a locked nucleic acid
cctacaatcccaaagyc

SEQ ID NO: 18469 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (12)..(12): base is a locked nucleic acid
cctacaatcccaaagyc

SEQ ID NO: 18470 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (14)..(14): base is a locked nucleic acid
cctacaatcccaaagyc

SEQ ID NO: 18471 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (2)..(2): base is a locked nucleic acid
  modified_base (8)..(8): base is a locked nucleic acid
  modified_base (9)..(9): base is a locked nucleic acid
cctacaatcccaaagyc

SEQ ID NO: 18472 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (3)..(3): base is a locked nucleic acid
  modified_base (8)..(8): base is a locked nucleic acid
  modified_base (9)..(9): base is a locked nucleic acid
cctacaatcccaaagyc

SEQ ID NO: 18473 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (7)..(7): base is a locked nucleic acid
  modified_base (8)..(8): base is a locked nucleic acid
  modified_base (9)..(9): base is a locked nucleic acid
cctacaatcccaaagyc

SEQ ID NO: 18474 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (5)..(5): base is a locked nucleic acid
  modified_base (8)..(8): base is a locked nucleic acid
  modified_base (9)..(9): base is a locked nucleic acid
cctacaatcccaaagyc

SEQ ID NO: 18475 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (8)..(8): base is a locked nucleic acid
  modified_base (9)..(9): base is a locked nucleic acid
  modified_base (14)..(14): base is a locked nucleic acid
cctacaatcccaaagyc

SEQ ID NO: 18476 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (8)..(8): base is a locked nucleic acid
  modified_base (9)..(9): base is a locked nucleic acid
  modified_base (10)..(10): base is a locked nucleic acid
cctacaatcccaaagyc

SEQ ID NO: 18477 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (8)..(8): base is a locked nucleic acid
  modified_base (9)..(9): base is a locked nucleic acid
  modified_base (13)..(13): base is a locked nucleic acid
cctacaatcccaaagyc

SEQ ID NO: 18478 - DNA, 17 bp, Artificial Sequence
  Oligonucleotide probe
  misc_binding (1)..(17): Hybridization probe for the specific detection of mutant HIV-1 at codon 145 of the integrase gene.
  modified_base (8)..(8): base is a locked nucleic acid
  modified_base (9)..(9): base is a locked nucleic acid
  modified_base (17)..(17): base is a locked nucleic acid
cctacaatcccaaagyc

SEQ ID NO: 18479 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (8)..(8): base is a locked nucleic acid
  modified_base (9)..(9): base is a locked nucleic acid
cctacaatcccaaag

SEQ ID NO: 18480 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (1)..(1): base is a locked nucleic acid
cctacaatcccaaag

SEQ ID NO: 18481 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (2)..(2): base is a locked nucleic acid
cctacaatcccaaag

SEQ ID NO: 18482 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (8)..(8): base is a locked nucleic acid
cctacaatcccaaag

SEQ ID NO: 18483 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (3)..(3): base is a locked nucleic acid
cctacaatcccaaag

SEQ ID NO: 18484 - DNA, 16 bp, Artificial Sequence
  Oligonucleotide probe
  misc_binding (1)..(16): Hybridization probe for the specific detection of mutant HIV-1 at codon 145 of the integrase gene.
cctacaatcccaaagy

SEQ ID NO: 18485 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (13)..(13): base is a locked nucleic acid
cctacaatcccaaag

SEQ ID NO: 18486 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (12)..(12): base is a locked nucleic acid
cctacaatcccaaag

SEQ ID NO: 18487 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (14)..(14): base is a locked nucleic acid
cctacaatcccaaag

SEQ ID NO: 18488 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (2)..(2): base is a locked nucleic acid
  modified_base (8)..(8): base is a locked nucleic acid
  modified_base (9)..(9): base is a locked nucleic acid
cctacaatcccaaag

SEQ ID NO: 18489 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (3)..(3): base is a locked nucleic acid
  modified_base (8)..(8): base is a locked nucleic acid
  modified_base (9)..(9): base is a locked nucleic acid
cctacaatcccaaag

SEQ ID NO: 18490 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (7)..(7): base is a locked nucleic acid
  modified_base (8)..(8): base is a locked nucleic acid
  modified_base (9)..(9): base is a locked nucleic acid
cctacaatcccaaag

SEQ ID NO: 18491 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (5)..(5): base is a locked nucleic acid
  modified_base (8)..(8): base is a locked nucleic acid
  modified_base (9)..(9): base is a locked nucleic acid
cctacaatcccaaag

SEQ ID NO: 18492 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (8)..(8): base is a locked nucleic acid
  modified_base (9)..(9): base is a locked nucleic acid
  modified_base (14)..(14): base is a locked nucleic acid
cctacaatcccaaag

SEQ ID NO: 18493 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (8)..(8): base is a locked nucleic acid
  modified_base (9)..(9): base is a locked nucleic acid
  modified_base (10)..(10): base is a locked nucleic acid
cctacaatcccaaag

SEQ ID NO: 18494 - DNA, 15 bp, Artificial Sequence
  Oligonucleotide probe
  misc_binding (1)..(15): Hybridization probe for the specific detection of mutant HIV-1 at codon 145 of the integrase gene.
  modified_base (8)..(8): base is a locked nucleic acid
  modified_base (9)..(9): base is a locked nucleic acid
  modified_base (13)..(13): base is a locked nucleic acid
cctacaatcccaaag

SEQ ID NO: 18495 - DNA, 16 bp, Artificial Sequence
  Oligonucleotide probe
  misc_binding (1)..(16): Hybridization probe for the specific detection of mutant HIV-1 at codon 145 of the integrase gene.
  modified_base (8)..(8): base is a locked nucleic acid
  modified_base (9)..(9): base is a locked nucleic acid
cctacaatcccaaagy

SEQ ID NO: 18496 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (8)..(8): base is a locked nucleic acid
  modified_base (9)..(9): base is a locked nucleic acid
cctacaatcccaa

SEQ ID NO: 18497 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (1)..(1): base is a locked nucleic acid
cctacaatcccaa

SEQ ID NO: 18498 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (2)..(2): base is a locked nucleic acid
cctacaatcccaa

SEQ ID NO: 18499 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (8)..(8): base is a locked nucleic acid
cctacaatcccaa

SEQ ID NO: 18500 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (3)..(3): base is a locked nucleic acid
cctacaatcccaa

SEQ ID NO: 18501 - DNA, 14 bp, Artificial Sequence
  Oligonucleotide probe
  misc_binding (1)..(14): Hybridization probe for the specific detection of mutant HIV-1 at codon 145 of the integrase gene.
cctacaatcccaaa

SEQ ID NO: 18502 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (13)..(13): base is a locked nucleic acid
cctacaatcccaa

SEQ ID NO: 18503 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (12)..(12): base is a locked nucleic acid
cctacaatcccaa

SEQ ID NO: 18504 - DNA, 13 bp, Artificial Sequence
  Oligonucleotide probe
  misc_binding (1)..(13): Hybridization probe for the specific detection of mutant HIV-1 at codon 145 of the integrase gene.
cctacaatcccaa

SEQ ID NO: 18505 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (2)..(2): base is a locked nucleic acid
  modified_base (8)..(8): base is a locked nucleic acid
  modified_base (9)..(9): base is a locked nucleic acid
cctacaatcccaa

SEQ ID NO: 18506 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (3)..(3): base is a locked nucleic acid
  modified_base (8)..(8): base is a locked nucleic acid
  modified_base (9)..(9): base is a locked nucleic acid
cctacaatcccaa

SEQ ID NO: 18507 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (7)..(7): base is a locked nucleic acid
  modified_base (8)..(8): base is a locked nucleic acid
  modified_base (9)..(9): base is a locked nucleic acid
cctacaatcccaa

SEQ ID NO: 18508 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (5)..(5): base is a locked nucleic acid
  modified_base (8)..(8): base is a locked nucleic acid
  modified_base (9)..(9): base is a locked nucleic acid
cctacaatcccaa

SEQ ID NO: 18509 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (8)..(8): base is a locked nucleic acid
  modified_base (9)..(9): base is a locked nucleic acid
cctacaatcccaa

SEQ ID NO: 18510 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (8)..(8): base is a locked nucleic acid
  modified_base (9)..(9): base is a locked nucleic acid
  modified_base (10)..(10): base is a locked nucleic acid
cctacaatcccaa

SEQ ID NO: 18511 - DNA, 13 bp, Artificial Sequence
  Oligonucleotide probe
  misc_binding (1)..(13): Hybridization probe for the specific detection of mutant HIV-1 at codon 145 of the integrase gene.
  modified_base (8)..(8): base is a locked nucleic acid
  modified_base (9)..(9): base is a locked nucleic acid
  modified_base (13)..(13): base is a locked nucleic acid
cctacaatcccaa

SEQ ID NO: 18512 - DNA, 14 bp, Artificial Sequence
  Oligonucleotide probe
  misc_binding (1)..(14): Hybridization probe for the specific detection of mutant HIV-1 at codon 145 of the integrase gene.
  modified_base (8)..(8): base is a locked nucleic acid
  modified_base (9)..(9): base is a locked nucleic acid
cctacaatcccaaa

SEQ ID NO: 18513 - DNA, 18 bp, Artificial Sequence
  Oligonucleotide probe
  misc_binding (1)..(18): Hybridization probe for the specific detection of mutant HIV-1 at codon 145 of the integrase gene.
ccctacaatcccaaagyc

SEQ ID NO: 18514 - DNA, 17 bp, Artificial Sequence
  Oligonucleotide probe
  misc_binding (1)..(17): Hybridization probe for the specific detection of mutant HIV-1 at codon 145 of the integrase gene.
cctacaatcccaaagyc

SEQ ID NO: 18515 - DNA, 15 bp, Artificial Sequence
  Oligonucleotide probe
  misc_binding (1)..(15): Hybridization probe for the specific detection of mutant HIV-1 at codon 145 of the integrase gene.
cctacaatcccaaag

SEQ ID NO: 18516 - DNA, 13 bp, Artificial Sequence
  Oligonucleotide probe
  misc_binding (1)..(13): Hybridization probe for the specific detection of mutant HIV-1 at codon 145 of the integrase gene.
cctacaatcccaa

SEQ ID NO: 18517 - DNA, 15 bp, Artificial Sequence
  Oligonucleotide probe
  misc_binding (1)..(15): Hybridization probe for the specific detection of mutant HIV-1 at codon 145 of the integrase gene.
tacaatagycaaagt

SEQ ID NO: 18518 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (9)..(9): base is a locked nucleic acid
  modified_base (10)..(10): base is a locked nucleic acid
acaatccccaagycargg

SEQ ID NO: 18519 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (6)..(6): base is a locked nucleic acid
acaatccccaagycargg

SEQ ID NO: 18520 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (8)..(8): base is a locked nucleic acid
acaatccccaagycargg

SEQ ID NO: 18521 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (5)..(5): base is a locked nucleic acid
acaatccccaagycargg

SEQ ID NO: 18522 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (4)..(4): base is a locked nucleic acid
acaatccccaagycargg

SEQ ID NO: 18523 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (16)..(16): base is a locked nucleic acid
acaatccccaagycargg

SEQ ID NO: 18524 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (10)..(10): base is a locked nucleic acid
acaatccccaagycargg

SEQ ID NO: 18525 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (15)..(15): base is a locked nucleic acid
acaatccccaagycargg

SEQ ID NO: 18526 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (14)..(14): base is a locked nucleic acid
acaatccccaagycargg

SEQ ID NO: 18527 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (5)..(5): base is a locked nucleic acid
  modified_base (9)..(9): base is a locked nucleic acid
  modified_base (10)..(10): base is a locked nucleic acid
acaatccccaagycargg

SEQ ID NO: 18528 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (2)..(2): base is a locked nucleic acid
  modified_base (9)..(9): base is a locked nucleic acid
  modified_base (10)..(10): base is a locked nucleic acid
acaatccccaagycargg

SEQ ID NO: 18529 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (3)..(3): base is a locked nucleic acid
  modified_base (9)..(9): base is a locked nucleic acid
  modified_base (10)..(10): base is a locked nucleic acid
acaatccccaagycargg

SEQ ID NO: 18530 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (6)..(6): base is a locked nucleic acid
  modified_base (9)..(9): base is a locked nucleic acid
  modified_base (10)..(10): base is a locked nucleic acid
acaatccccaagycargg

SEQ ID NO: 18531 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (9)..(9): base is a locked nucleic acid
  modified_base (10)..(10): base is a locked nucleic acid
  modified_base (17)..(17): base is a locked nucleic acid
acaatccccaagycargg

SEQ ID NO: 18532 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (9)..(9): base is a locked nucleic acid
  modified_base (10)..(10): base is a locked nucleic acid
  modified_base (11)..(11): base is a locked nucleic acid
acaatccccaagycargg

SEQ ID NO: 18533 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (9)..(9): base is a locked nucleic acid
  modified_base (10)..(10): base is a locked nucleic acid
  modified_base (14)..(14): base is a locked nucleic acid
acaatccccaagycargg

SEQ ID NO: 18534 - DNA, 18 bp, Artificial Sequence
  Oligonucleotide probe
  misc_binding (1)..(18): Hybridization probe for the specific detection of mutant HIV-1 at codon 146 of the integrase gene.
  modified_base (9)..(9): base is a locked nucleic acid
  modified_base (10)..(10): base is a locked nucleic acid
  modified_base (16)..(16): base is a locked nucleic acid
acaatccccaagycargg

SEQ ID NO: 18535 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (8)..(8): base is a locked nucleic acid
  modified_base (9)..(9): base is a locked nucleic acid
caatccccaagycargg

SEQ ID NO: 18536 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (5)..(5): base is a locked nucleic acid
caatccccaagycargg

SEQ ID NO: 18537 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (7)..(7): base is a locked nucleic acid
caatccccaagycargg

SEQ ID NO: 18538 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (4)..(4): base is a locked nucleic acid
caatccccaagycargg

SEQ ID NO: 18539 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (3)..(3): base is a locked nucleic acid
caatccccaagycargg

SEQ ID NO: 18540 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (15)..(15): base is a locked nucleic acid
caatccccaagycargg

SEQ ID NO: 18541 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (9)..(9): base is a locked nucleic acid
caatccccaagycargg

SEQ ID NO: 18542 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (14)..(14): base is a locked nucleic acid
caatccccaagycargg

SEQ ID NO: 18543 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (13)..(13): base is a locked nucleic acid
caatccccaagycargg

SEQ ID NO: 18544 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (4)..(4): base is a locked nucleic acid
  modified_base (8)..(8): base is a locked nucleic acid
  modified_base (9)..(9): base is a locked nucleic acid
caatccccaagycargg

SEQ ID NO: 18545 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (1)..(1): base is a locked nucleic acid
  modified_base (8)..(8): base is a locked nucleic acid
  modified_base (9)..(9): base is a locked nucleic acid
caatccccaagycargg

SEQ ID NO: 18546 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (2)..(2): base is a locked nucleic acid
  modified_base (8)..(8): base is a locked nucleic acid
  modified_base (9)..(9): base is a locked nucleic acid
caatccccaagycargg

SEQ ID NO: 18547 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (5)..(5): base is a locked nucleic acid
  modified_base (8)..(8): base is a locked nucleic acid
  modified_base (9)..(9): base is a locked nucleic acid
caatccccaagycargg

SEQ ID NO: 18548 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (8)..(8): base is a locked nucleic acid
  modified_base (9)..(9): base is a locked nucleic acid
  modified_base (16)..(16): base is a locked nucleic acid
caatccccaagycargg

SEQ ID NO: 18549 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (8)..(8): base is a locked nucleic acid
  modified_base (9)..(9): base is a locked nucleic acid
  modified_base (10)..(10): base is a locked nucleic acid
caatccccaagycargg

SEQ ID NO: 18550 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (8)..(8): base is a locked nucleic acid
  modified_base (9)..(9): base is a locked nucleic acid
  modified_base (13)..(13): base is a locked nucleic acid
caatccccaagycargg

SEQ ID NO: 18551 - DNA, 17 bp, Artificial Sequence
  Oligonucleotide probe
  misc_binding (1)..(17): Hybridization probe for the specific detection of mutant HIV-1 at codon 146 of the integrase gene.
  modified_base (8)..(8): base is a locked nucleic acid
  modified_base (9)..(9): base is a locked nucleic acid
  modified_base (15)..(15): base is a locked nucleic acid
caatccccaagycargg

SEQ ID NO: 18552 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (8)..(8): base is a locked nucleic acid
  modified_base (9)..(9): base is a locked nucleic acid
caatccccaagycar

SEQ ID NO: 18553 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (5)..(5): base is a locked nucleic acid
caatccccaagycar

SEQ ID NO: 18554 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (7)..(7): base is a locked nucleic acid
caatccccaagycar

SEQ ID NO: 18555 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (4)..(4): base is a locked nucleic acid
caatccccaagycar

SEQ ID NO: 18556 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (3)..(3): base is a locked nucleic acid
caatccccaagycar

SEQ ID NO: 18557 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (15)..(15): base is a locked nucleic acid
caatccccaagycar

SEQ ID NO: 18558 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (9)..(9): base is a locked nucleic acid
caatccccaagycar

SEQ ID NO: 18559 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (14)..(14): base is a locked nucleic acid
caatccccaagycar

SEQ ID NO: 18560 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (13)..(13): base is a locked nucleic acid
caatccccaagycar

SEQ ID NO: 18561 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (4)..(4): base is a locked nucleic acid
  modified_base (8)..(8): base is a locked nucleic acid
  modified_base (9)..(9): base is a locked nucleic acid
caatccccaagycar

SEQ ID NO: 18562 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (1)..(1): base is a locked nucleic acid
  modified_base (8)..(8): base is a locked nucleic acid
  modified_base (9)..(9): base is a locked nucleic acid
caatccccaagycar

SEQ ID NO: 18563 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (2)..(2): base is a locked nucleic acid
  modified_base (8)..(8): base is a locked nucleic acid
  modified_base (9)..(9): base is a locked nucleic acid
caatccccaagycar

SEQ ID NO: 18564 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (5)..(5): base is a locked nucleic acid
  modified_base (8)..(8): base is a locked nucleic acid
  modified_base (9)..(9): base is a locked nucleic acid
caatccccaagycar

SEQ ID NO: 18565 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (8)..(8): base is a locked nucleic acid
  modified_base (9)..(9): base is a locked nucleic acid
caatccccaagycar

SEQ ID NO: 18566 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (8)..(8): base is a locked nucleic acid
  modified_base (9)..(9): base is a locked nucleic acid
  modified_base (10)..(10): base is a locked nucleic acid
caatccccaagycar

SEQ ID NO: 18567 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (8)..(8): base is a locked nucleic acid
  modified_base (9)..(9): base is a locked nucleic acid
  modified_base (13)..(13): base is a locked nucleic acid
caatccccaagycar

SEQ ID NO: 18568 - DNA, 15 bp, Artificial Sequence
  Oligonucleotide probe
  misc_binding (1)..(15): Hybridization probe for the specific detection of mutant HIV-1 at codon 146 of the integrase gene.
  modified_base (8)..(8): base is a locked nucleic acid
  modified_base (9)..(9): base is a locked nucleic acid
  modified_base (15)..(15): base is a locked nucleic acid
caatccccaagycar

SEQ ID NO: 18569 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (8)..(8): base is a locked nucleic acid
  modified_base (9)..(9): base is a locked nucleic acid
caatccccaagyc

SEQ ID NO: 18570 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (5)..(5): base is a locked nucleic acid
caatccccaagyc

SEQ ID NO: 18571 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (7)..(7): base is a locked nucleic acid
caatccccaagyc

SEQ ID NO: 18572 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (4)..(4): base is a locked nucleic acid
caatccccaagyc

SEQ ID NO: 18573 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (3)..(3): base is a locked nucleic acid
caatccccaagyc

SEQ ID NO: 18574 - DNA, 14 bp, Artificial Sequence
  Oligonucleotide probe
  misc_binding (1)..(14): Hybridization probe for the specific detection of mutant HIV-1 at codon 146 of the integrase gene.
caatccccaagyca

SEQ ID NO: 18575 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (9)..(9): base is a locked nucleic acid
caatccccaagyc

SEQ ID NO: 18576 - DNA, 13 bp, Artificial Sequence
  Oligonucleotide probe
  misc_binding (1)..(13): Hybridization probe for the specific detection of mutant HIV-1 at codon 146 of the integrase gene.
caatccccaagyc

SEQ ID NO: 18577 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (13)..(13): base is a locked nucleic acid
caatccccaagyc

SEQ ID NO: 18578 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (4)..(4): base is a locked nucleic acid
  modified_base (8)..(8): base is a locked nucleic acid
  modified_base (9)..(9): base is a locked nucleic acid
caatccccaagyc

SEQ ID NO: 18579 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (1)..(1): base is a locked nucleic acid
  modified_base (8)..(8): base is a locked nucleic acid
  modified_base (9)..(9): base is a locked nucleic acid
caatccccaagyc

SEQ ID NO: 18580 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (2)..(2): base is a locked nucleic acid
  modified_base (8)..(8): base is a locked nucleic acid
  modified_base (9)..(9): base is a locked nucleic acid
caatccccaagyc

SEQ ID NO: 18581 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (5)..(5): base is a locked nucleic acid
  modified_base (8)..(8): base is a locked nucleic acid
  modified_base (9)..(9): base is a locked nucleic acid
caatccccaagyc

SEQ ID NO: 18582 - DNA, 14 bp, Artificial Sequence
  Oligonucleotide probe
  misc_binding (1)..(14): Hybridization probe for the specific detection of mutant HIV-1 at codon 146 of the integrase gene.
  modified_base (8)..(8): base is a locked nucleic acid
  modified_base (9)..(9): base is a locked nucleic acid
caatccccaagyca

SEQ ID NO: 18583 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (8)..(8): base is a locked nucleic acid
  modified_base (9)..(9): base is a locked nucleic acid
  modified_base (10)..(10): base is a locked nucleic acid
caatccccaagyc

SEQ ID NO: 18584 - DNA, 13 bp, Artificial Sequence
  Oligonucleotide probe
  misc_binding (1)..(13): Hybridization probe for the specific detection of mutant HIV-1 at codon 146 of the integrase gene.
  modified_base (8)..(8): base is a locked nucleic acid
  modified_base (9)..(9): base is a locked nucleic acid
  modified_base (13)..(13): base is a locked nucleic acid
caatccccaagyc

SEQ ID NO: 18585 - DNA, 18 bp, Artificial Sequence
  Oligonucleotide probe
  misc_binding (1)..(18): Hybridization probe for the specific detection of mutant HIV-1 at codon 146 of the integrase gene.
acaatccccaagycargg

SEQ ID NO: 18586 - DNA, 17 bp, Artificial Sequence
  Oligonucleotide probe
  misc_binding (1)..(17): Hybridization probe for the specific detection of mutant HIV-1 at codon 146 of the integrase gene.
caatccccaagycargg

SEQ ID NO: 18587 - DNA, 15 bp, Artificial Sequence
  Oligonucleotide probe
  misc_binding (1)..(15): Hybridization probe for the specific detection of mutant HIV-1 at codon 146 of the integrase gene.
caatccccaagycar

SEQ ID NO: 18588 - DNA, 13 bp, Artificial Sequence
  Oligonucleotide probe
  misc_binding (1)..(13): Hybridization probe for the specific detection of mutant HIV-1 at codon 146 of the integrase gene.
caatccccaagyc

SEQ ID NO: 18589 - DNA, 15 bp, Artificial Sequence
  Oligonucleotide probe
  misc_binding (1)..(15): Hybridization probe for the specific detection of mutant HIV-1 at codon 146 of the integrase gene.
aatcccccragtcaa

SEQ ID NO: 18590 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (9)..(9): base is a locked nucleic acid
  modified_base (10)..(10): base is a locked nucleic acid
aatccccaagycarggag

SEQ ID NO: 18591 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (8)..(8): base is a locked nucleic acid
aatccccaagycarggag

SEQ ID NO: 18592 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (4)..(4): base is a locked nucleic acid
aatccccaagycarggag

SEQ ID NO: 18593 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (7)..(7): base is a locked nucleic acid
aatccccaagycarggag

SEQ ID NO: 18594 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (6)..(6): base is a locked nucleic acid
aatccccaagycarggag

SEQ ID NO: 18595 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (16)..(16): base is a locked nucleic acid
aatccccaagycarggag

SEQ ID NO: 18596 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (17)..(17): base is a locked nucleic acid
aatccccaagycarggag

SEQ ID NO: 18597 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (18)..(18): base is a locked nucleic acid
aatccccaagycarggag

SEQ ID NO: 18598 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (12)..(12): base is a locked nucleic acid
aatccccaagycarggag

SEQ ID NO: 18599 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (2)..(2): base is a locked nucleic acid
  modified_base (9)..(9): base is a locked nucleic acid
  modified_base (10)..(10): base is a locked nucleic acid
aatccccaagycarggag

SEQ ID NO: 18600 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (7)..(7): base is a locked nucleic acid
  modified_base (9)..(9): base is a locked nucleic acid
  modified_base (10)..(10): base is a locked nucleic acid
aatccccaagycarggag

SEQ ID NO: 18601 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (5)..(5): base is a locked nucleic acid
  modified_base (9)..(9): base is a locked nucleic acid
  modified_base (10)..(10): base is a locked nucleic acid
aatccccaagycarggag

SEQ ID NO: 18602 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (4)..(4): base is a locked nucleic acid
  modified_base (9)..(9): base is a locked nucleic acid
  modified_base (10)..(10): base is a locked nucleic acid
aatccccaagycarggag

SEQ ID NO: 18603 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (9)..(9): base is a locked nucleic acid
  modified_base (10)..(10): base is a locked nucleic acid
  modified_base (14)..(14): base is a locked nucleic acid
aatccccaagycarggag

SEQ ID NO: 18604 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (9)..(9): base is a locked nucleic acid
  modified_base (10)..(10): base is a locked nucleic acid
  modified_base (11)..(11): base is a locked nucleic acid
aatccccaagycarggag

SEQ ID NO: 18605 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (9)..(9): base is a locked nucleic acid
  modified_base (10)..(10): base is a locked nucleic acid
  modified_base (12)..(12): base is a locked nucleic acid
aatccccaagycarggag

SEQ ID NO: 18606 - DNA, 18 bp, Artificial Sequence
  Oligonucleotide probe
  misc_binding (1)..(18): Hybridization probe for the specific detection of mutant HIV-1 at codon 147 of the integrase gene.
  modified_base (9)..(9): base is a locked nucleic acid
  modified_base (10)..(10): base is a locked nucleic acid
  modified_base (17)..(17): base is a locked nucleic acid
aatccccaagycarggag

SEQ ID NO: 18607 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (8)..(8): base is a locked nucleic acid
  modified_base (9)..(9): base is a locked nucleic acid
atccccaagycarggag

SEQ ID NO: 18608 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (7)..(7): base is a locked nucleic acid
atccccaagycarggag

SEQ ID NO: 18609 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (3)..(3): base is a locked nucleic acid
atccccaagycarggag

SEQ ID NO: 18610 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (6)..(6): base is a locked nucleic acid
atccccaagycarggag

SEQ ID NO: 18611 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (5)..(5): base is a locked nucleic acid
atccccaagycarggag

SEQ ID NO: 18612 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (15)..(15): base is a locked nucleic acid
atccccaagycarggag

SEQ ID NO: 18613 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (16)..(16): base is a locked nucleic acid
atccccaagycarggag

SEQ ID NO: 18614 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (17)..(17): base is a locked nucleic acid
atccccaagycarggag

SEQ ID NO: 18615 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (11)..(11): base is a locked nucleic acid
atccccaagycarggag

SEQ ID NO: 18616 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (1)..(1): base is a locked nucleic acid
  modified_base (8)..(8): base is a locked nucleic acid
  modified_base (9)..(9): base is a locked nucleic acid
atccccaagycarggag

SEQ ID NO: 18617 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (6)..(6): base is a locked nucleic acid
  modified_base (8)..(8): base is a locked nucleic acid
  modified_base (9)..(9): base is a locked nucleic acid
atccccaagycarggag

SEQ ID NO: 18618 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (4)..(4): base is a locked nucleic acid
  modified_base (8)..(8): base is a locked nucleic acid
  modified_base (9)..(9): base is a locked nucleic acid
atccccaagycarggag

SEQ ID NO: 18619 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (3)..(3): base is a locked nucleic acid
  modified_base (8)..(8): base is a locked nucleic acid
  modified_base (9)..(9): base is a locked nucleic acid
atccccaagycarggag

SEQ ID NO: 18620 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (8)..(8): base is a locked nucleic acid
  modified_base (9)..(9): base is a locked nucleic acid
  modified_base (13)..(13): base is a locked nucleic acid
atccccaagycarggag

SEQ ID NO: 18621 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (8)..(8): base is a locked nucleic acid
  modified_base (9)..(9): base is a locked nucleic acid
  modified_base (10)..(10): base is a locked nucleic acid
atccccaagycarggag

SEQ ID NO: 18622 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (8)..(8): base is a locked nucleic acid
  modified_base (9)..(9): base is a locked nucleic acid
  modified_base (11)..(11): base is a locked nucleic acid
atccccaagycarggag

SEQ ID NO: 18623 - DNA, 17 bp, Artificial Sequence
  Oligonucleotide probe
  misc_binding (1)..(17): Hybridization probe for the specific detection of mutant HIV-1 at codon 147 of the integrase gene.
  modified_base (8)..(8): base is a locked nucleic acid
  modified_base (9)..(9): base is a locked nucleic acid
  modified_base (16)..(16): base is a locked nucleic acid
atccccaagycarggag

SEQ ID NO: 18624 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (8)..(8): base is a locked nucleic acid
  modified_base (9)..(9): base is a locked nucleic acid
atccccaagycargg

SEQ ID NO: 18625 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (7)..(7): base is a locked nucleic acid
atccccaagycargg

SEQ ID NO: 18626 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (3)..(3): base is a locked nucleic acid
atccccaagycargg

SEQ ID NO: 18627 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (6)..(6): base is a locked nucleic acid
atccccaagycargg

SEQ ID NO: 18628 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (5)..(5): base is a locked nucleic acid
atccccaagycargg

SEQ ID NO: 18629 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (15)..(15): base is a locked nucleic acid
atccccaagycargg

SEQ ID NO: 18630 - DNA, 15 bp, Artificial Sequence
  Oligonucleotide probe
  misc_binding (1)..(15): Hybridization probe for the specific detection of mutant HIV-1 at codon 147 of the integrase gene.
atccccaagycargg

SEQ ID NO: 18631 - DNA, 16 bp, Artificial Sequence
  Oligonucleotide probe
  misc_binding (1)..(16): Hybridization probe for the specific detection of mutant HIV-1 at codon 147 of the integrase gene.
atccccaagycargga

SEQ ID NO: 18632 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (11)..(11): base is a locked nucleic acid
atccccaagycargg

SEQ ID NO: 18633 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (1)..(1): base is a locked nucleic acid
  modified_base (8)..(8): base is a locked nucleic acid
  modified_base (9)..(9): base is a locked nucleic acid
atccccaagycargg

SEQ ID NO: 18634 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (6)..(6): base is a locked nucleic acid
  modified_base (8)..(8): base is a locked nucleic acid
  modified_base (9)..(9): base is a locked nucleic acid
atccccaagycargg

SEQ ID NO: 18635 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (4)..(4): base is a locked nucleic acid
  modified_base (8)..(8): base is a locked nucleic acid
  modified_base (9)..(9): base is a locked nucleic acid
atccccaagycargg

SEQ ID NO: 18636 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (3)..(3): base is a locked nucleic acid
  modified_base (8)..(8): base is a locked nucleic acid
  modified_base (9)..(9): base is a locked nucleic acid
atccccaagycargg

SEQ ID NO: 18637 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (8)..(8): base is a locked nucleic acid
  modified_base (9)..(9): base is a locked nucleic acid
  modified_base (13)..(13): base is a locked nucleic acid
atccccaagycargg

SEQ ID NO: 18638 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (8)..(8): base is a locked nucleic acid
  modified_base (9)..(9): base is a locked nucleic acid
  modified_base (10)..(10): base is a locked nucleic acid
atccccaagycargg

SEQ ID NO: 18639 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (8)..(8): base is a locked nucleic acid
  modified_base (9)..(9): base is a locked nucleic acid
  modified_base (11)..(11): base is a locked nucleic acid
atccccaagycargg

SEQ ID NO: 18640 - DNA, 15 bp, Artificial Sequence
  Oligonucleotide probe
  misc_binding (1)..(15): Hybridization probe for the specific detection of mutant HIV-1 at codon 147 of the integrase gene.
  modified_base (8)..(8): base is a locked nucleic acid
  modified_base (9)..(9): base is a locked nucleic acid
atccccaagycargg

SEQ ID NO: 18641 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (8)..(8): base is a locked nucleic acid
  modified_base (9)..(9): base is a locked nucleic acid
atccccaagycar

SEQ ID NO: 18642 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (7)..(7): base is a locked nucleic acid
atccccaagycar

SEQ ID NO: 18643 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (3)..(3): base is a locked nucleic acid
atccccaagycar

SEQ ID NO: 18644 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (6)..(6): base is a locked nucleic acid
atccccaagycar

SEQ ID NO: 18645 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (5)..(5): base is a locked nucleic acid
atccccaagycar

SEQ ID NO: 18646 - DNA, 14 bp, Artificial Sequence
  Oligonucleotide probe
  misc_binding (1)..(14): Hybridization probe for the specific detection of mutant HIV-1 at codon 147 of the integrase gene.
atccccaagycarg

SEQ ID NO: 18647 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (11)..(11): base is a locked nucleic acid
atccccaagycar

SEQ ID NO: 18648 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (1)..(1): base is a locked nucleic acid
  modified_base (8)..(8): base is a locked nucleic acid
  modified_base (9)..(9): base is a locked nucleic acid
atccccaagycar

SEQ ID NO: 18649 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (6)..(6): base is a locked nucleic acid
  modified_base (8)..(8): base is a locked nucleic acid
  modified_base (9)..(9): base is a locked nucleic acid
atccccaagycar

SEQ ID NO: 18650 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (4)..(4): base is a locked nucleic acid
  modified_base (8)..(8): base is a locked nucleic acid
  modified_base (9)..(9): base is a locked nucleic acid
atccccaagycar

SEQ ID NO: 18651 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (3)..(3): base is a locked nucleic acid
  modified_base (8)..(8): base is a locked nucleic acid
  modified_base (9)..(9): base is a locked nucleic acid
atccccaagycar

SEQ ID NO: 18652 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (8)..(8): base is a locked nucleic acid
  modified_base (9)..(9): base is a locked nucleic acid
  modified_base (13)..(13): base is a locked nucleic acid
atccccaagycar

SEQ ID NO: 18653 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (8)..(8): base is a locked nucleic acid
  modified_base (9)..(9): base is a locked nucleic acid
  modified_base (10)..(10): base is a locked nucleic acid
atccccaagycar

SEQ ID NO: 18654 - DNA, 13 bp, Artificial Sequence
  Oligonucleotide probe
  misc_binding (1)..(13): Hybridization probe for the specific detection of mutant HIV-1 at codon 147 of the integrase gene.
  modified_base (8)..(8): base is a locked nucleic acid
  modified_base (9)..(9): base is a locked nucleic acid
  modified_base (11)..(11): base is a locked nucleic acid
atccccaagycar

SEQ ID NO: 18655 - DNA, 14 bp, Artificial Sequence
  Oligonucleotide probe
  misc_binding (1)..(14): Hybridization probe for the specific detection of mutant HIV-1 at codon 147 of the integrase gene.
  modified_base (8)..(8): base is a locked nucleic acid
  modified_base (9)..(9): base is a locked nucleic acid
atccccaagycarg

SEQ ID NO: 18656 - DNA, 18 bp, Artificial Sequence
  Oligonucleotide probe
  misc_binding (1)..(18): Hybridization probe for the specific detection of mutant HIV-1 at codon 147 of the integrase gene.
aatccccaagycarggag

SEQ ID NO: 18657 - DNA, 17 bp, Artificial Sequence
  Oligonucleotide probe
  misc_binding (1)..(17): Hybridization probe for the specific detection of mutant HIV-1 at codon 147 of the integrase gene.
atccccaagycarggag

SEQ ID NO: 18658 - DNA, 15 bp, Artificial Sequence
  Oligonucleotide probe
  misc_binding (1)..(15): Hybridization probe for the specific detection of mutant HIV-1 at codon 147 of the integrase gene.
atccccaagycargg

SEQ ID NO: 18659 - DNA, 13 bp, Artificial Sequence
  Oligonucleotide probe
  misc_binding (1)..(13): Hybridization probe for the specific detection of mutant HIV-1 at codon 147 of the integrase gene.
atccccaagycar

SEQ ID NO: 18660 - DNA, 15 bp, Artificial Sequence
  Oligonucleotide probe
  misc_binding (1)..(15): Hybridization probe for the specific detection of mutant HIV-1 at codon 147 of the integrase gene.
tccccaaggycaagg

SEQ ID NO: 18661 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
ccaaagycaggagtagtr

SEQ ID NO: 18662 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (6)..(6): base is a locked nucleic acid
ccaaagycaggagtagtr

SEQ ID NO: 18663 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (4)..(4): base is a locked nucleic acid
ccaaagycaggagtagtr

SEQ ID NO: 18664 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (2)..(2): base is a locked nucleic acid
ccaaagycaggagtagtr

SEQ ID NO: 18665 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (3)..(3): base is a locked nucleic acid
ccaaagycaggagtagtr

SEQ ID NO: 18666 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (15)..(15): base is a locked nucleic acid
ccaaagycaggagtagtr

SEQ ID NO: 18667 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (16)..(16): base is a locked nucleic acid
ccaaagycaggagtagtr

SEQ ID NO: 18668 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (13)..(13): base is a locked nucleic acid
ccaaagycaggagtagtr

SEQ ID NO: 18669 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (11)..(11): base is a locked nucleic acid
ccaaagycaggagtagtr

SEQ ID NO: 18670 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (10)..(10): base is a locked nucleic acid
ccaaagycaggagtagtr

SEQ ID NO: 18671 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (4)..(4): base is a locked nucleic acid
  modified_base (9)..(9): base is a locked nucleic acid
  modified_base (10)..(10): base is a locked nucleic acid
ccaaagycaggagtagtr

SEQ ID NO: 18672 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (3)..(3): base is a locked nucleic acid
  modified_base (9)..(9): base is a locked nucleic acid
  modified_base (10)..(10): base is a locked nucleic acid
ccaaagycaggagtagtr

SEQ ID NO: 18673 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (5)..(5): base is a locked nucleic acid
  modified_base (9)..(9): base is a locked nucleic acid
  modified_base (10)..(10): base is a locked nucleic acid
ccaaagycaggagtagtr

SEQ ID NO: 18674 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (12)..(12): base is a locked nucleic acid
ccaaagycaggagtagtr

SEQ ID NO: 18675 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (14)..(14): base is a locked nucleic acid
ccaaagycaggagtagtr

SEQ ID NO: 18676 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (18)..(18): base is a locked nucleic acid
ccaaagycaggagtagtr

SEQ ID NO: 18677 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (15)..(15): base is a locked nucleic acid
ccaaagycaggagtagtr

SEQ ID NO: 18678 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
ccccaaagyarggagtag

SEQ ID NO: 18679 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (4)..(4): base is a locked nucleic acid
ccccaaagyarggagtag

SEQ ID NO: 18680 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (6)..(6): base is a locked nucleic acid
ccccaaagyarggagtag

SEQ ID NO: 18681 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
ccccaaagyarggagtag

SEQ ID NO: 18682 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (8)..(8): base is a locked nucleic acid
ccccaaagyarggagtag

SEQ ID NO: 18683 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (16)..(16): base is a locked nucleic acid
ccccaaagyarggagtag

SEQ ID NO: 18684 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (13)..(13): base is a locked nucleic acid
ccccaaagyarggagtag

SEQ ID NO: 18685 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (10)..(10): base is a locked nucleic acid
ccccaaagyarggagtag

SEQ ID NO: 18686 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (12)..(12): base is a locked nucleic acid
ccccaaagyarggagtag

SEQ ID NO: 18687 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (4)..(4): base is a locked nucleic acid
  modified_base (9)..(9): base is a locked nucleic acid
  modified_base (10)..(10): base is a locked nucleic acid
ccccaaagyarggagtag

SEQ ID NO: 18688 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (6)..(6): base is a locked nucleic acid
  modified_base (9)..(9): base is a locked nucleic acid
  modified_base (10)..(10): base is a locked nucleic acid
ccccaaagyarggagtag

SEQ ID NO: 18689 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (3)..(3): base is a locked nucleic acid
  modified_base (9)..(9): base is a locked nucleic acid
  modified_base (10)..(10): base is a locked nucleic acid
ccccaaagyarggagtag

SEQ ID NO: 18690 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (5)..(5): base is a locked nucleic acid
  modified_base (9)..(9): base is a locked nucleic acid
  modified_base (10)..(10): base is a locked nucleic acid
ccccaaagyarggagtag

SEQ ID NO: 18691 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (12)..(12): base is a locked nucleic acid
ccccaaagyarggagtag

SEQ ID NO: 18692 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (15)..(15): base is a locked nucleic acid
ccccaaagyarggagtag

SEQ ID NO: 18693 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (16)..(16): base is a locked nucleic acid
ccccaaagyarggagtag

SEQ ID NO: 18694 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (18)..(18): base is a locked nucleic acid
ccccaaagyarggagtag

SEQ ID NO: 18695 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
cccaaagycrggagtagt

SEQ ID NO: 18696 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (6)..(6): base is a locked nucleic acid
cccaaagycrggagtagt

SEQ ID NO: 18697 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (4)..(4): base is a locked nucleic acid
cccaaagycrggagtagt

SEQ ID NO: 18698 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (8)..(8): base is a locked nucleic acid
cccaaagycrggagtagt

SEQ ID NO: 18699 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
cccaaagycrggagtagt

SEQ ID NO: 18700 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (15)..(15): base is a locked nucleic acid
cccaaagycrggagtagt

SEQ ID NO: 18701 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (17)..(17): base is a locked nucleic acid
cccaaagycrggagtagt

SEQ ID NO: 18702 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (13)..(13): base is a locked nucleic acid
cccaaagycrggagtagt

SEQ ID NO: 18703 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (11)..(11): base is a locked nucleic acid
cccaaagycrggagtagt

SEQ ID NO: 18704 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (10)..(10): base is a locked nucleic acid
cccaaagycrggagtagt

SEQ ID NO: 18705 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (3)..(3): base is a locked nucleic acid
  modified_base (9)..(9): base is a locked nucleic acid
  modified_base (10)..(10): base is a locked nucleic acid
cccaaagycrggagtagt

SEQ ID NO: 18706 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (7)..(7): base is a locked nucleic acid
  modified_base (9)..(9): base is a locked nucleic acid
  modified_base (10)..(10): base is a locked nucleic acid
cccaaagycrggagtagt

SEQ ID NO: 18707 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (2)..(2): base is a locked nucleic acid
  modified_base (9)..(9): base is a locked nucleic acid
  modified_base (10)..(10): base is a locked nucleic acid
cccaaagycrggagtagt

SEQ ID NO: 18708 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (13)..(13): base is a locked nucleic acid
cccaaagycrggagtagt

SEQ ID NO: 18709 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (11)..(11): base is a locked nucleic acid
cccaaagycrggagtagt

SEQ ID NO: 18710 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (15)..(15): base is a locked nucleic acid
cccaaagycrggagtagt

SEQ ID NO: 18711 - DNA, 18 bp, Artificial Sequence
  Oligonucleotide probe
  misc_binding (1)..(18): Hybridization probe for the specific detection of mutant HIV-1 at codon 148 of the integrase gene.
  modified_base (9)..(9): base is a locked nucleic acid
  modified_base (10)..(10): base is a locked nucleic acid
  modified_base (16)..(16): base is a locked nucleic acid
cccaaagycrggagtagt

SEQ ID NO: 18712 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
caaagycaggagtagtr

SEQ ID NO: 18713 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (5)..(5): base is a locked nucleic acid
caaagycaggagtagtr

SEQ ID NO: 18714 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (3)..(3): base is a locked nucleic acid
caaagycaggagtagtr

SEQ ID NO: 18715 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (1)..(1): base is a locked nucleic acid
caaagycaggagtagtr

SEQ ID NO: 18716 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (2)..(2): base is a locked nucleic acid
caaagycaggagtagtr

SEQ ID NO: 18717 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (14)..(14): base is a locked nucleic acid
caaagycaggagtagtr

SEQ ID NO: 18718 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (15)..(15): base is a locked nucleic acid
caaagycaggagtagtr

SEQ ID NO: 18719 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (12)..(12): base is a locked nucleic acid
caaagycaggagtagtr

SEQ ID NO: 18720 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (10)..(10): base is a locked nucleic acid
caaagycaggagtagtr

SEQ ID NO: 18721 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (7)..(7): base is a locked nucleic acid
  modified_base (8)..(8): base is a locked nucleic acid
  modified_base (9)..(9): base is a locked nucleic acid
caaagycaggagtagtr

SEQ ID NO: 18722 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (3)..(3): base is a locked nucleic acid
  modified_base (8)..(8): base is a locked nucleic acid
  modified_base (9)..(9): base is a locked nucleic acid
caaagycaggagtagtr

SEQ ID NO: 18723 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (2)..(2): base is a locked nucleic acid
  modified_base (8)..(8): base is a locked nucleic acid
  modified_base (9)..(9): base is a locked nucleic acid
caaagycaggagtagtr

SEQ ID NO: 18724 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (4)..(4): base is a locked nucleic acid
  modified_base (8)..(8): base is a locked nucleic acid
  modified_base (9)..(9): base is a locked nucleic acid
caaagycaggagtagtr

SEQ ID NO: 18725 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (11)..(11): base is a locked nucleic acid
caaagycaggagtagtr

SEQ ID NO: 18726 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (13)..(13): base is a locked nucleic acid
caaagycaggagtagtr

SEQ ID NO: 18727 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (17)..(17): base is a locked nucleic acid
caaagycaggagtagtr

SEQ ID NO: 18728 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (14)..(14): base is a locked nucleic acid
caaagycaggagtagtr

SEQ ID NO: 18729 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
cccaaagyarggagtag

SEQ ID NO: 18730 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (3)..(3): base is a locked nucleic acid
cccaaagyarggagtag

SEQ ID NO: 18731 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (5)..(5): base is a locked nucleic acid
cccaaagyarggagtag

SEQ ID NO: 18732 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
cccaaagyarggagtag

SEQ ID NO: 18733 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (7)..(7): base is a locked nucleic acid
cccaaagyarggagtag

SEQ ID NO: 18734 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (15)..(15): base is a locked nucleic acid
cccaaagyarggagtag

SEQ ID NO: 18735 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (12)..(12): base is a locked nucleic acid
cccaaagyarggagtag

SEQ ID NO: 18736 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (9)..(9): base is a locked nucleic acid
cccaaagyarggagtag

SEQ ID NO: 18737 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (11)..(11): base is a locked nucleic acid
cccaaagyarggagtag

SEQ ID NO: 18738 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (3)..(3): base is a locked nucleic acid
  modified_base (8)..(8): base is a locked nucleic acid
  modified_base (9)..(9): base is a locked nucleic acid
cccaaagyarggagtag

SEQ ID NO: 18739 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (5)..(5): base is a locked nucleic acid
  modified_base (8)..(8): base is a locked nucleic acid
  modified_base (9)..(9): base is a locked nucleic acid
cccaaagyarggagtag

SEQ ID NO: 18740 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (2)..(2): base is a locked nucleic acid
  modified_base (8)..(8): base is a locked nucleic acid
  modified_base (9)..(9): base is a locked nucleic acid
cccaaagyarggagtag

SEQ ID NO: 18741 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (4)..(4): base is a locked nucleic acid
  modified_base (8)..(8): base is a locked nucleic acid
  modified_base (9)..(9): base is a locked nucleic acid
cccaaagyarggagtag

SEQ ID NO: 18742 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (11)..(11): base is a locked nucleic acid
cccaaagyarggagtag

SEQ ID NO: 18743 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (14)..(14): base is a locked nucleic acid
cccaaagyarggagtag

SEQ ID NO: 18744 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (15)..(15): base is a locked nucleic acid
cccaaagyarggagtag

SEQ ID NO: 18745 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (17)..(17): base is a locked nucleic acid
cccaaagyarggagtag

SEQ ID NO: 18746 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
ccaaagycrggagtagt

SEQ ID NO: 18747 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (5)..(5): base is a locked nucleic acid
ccaaagycrggagtagt

SEQ ID NO: 18748 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (3)..(3): base is a locked nucleic acid
ccaaagycrggagtagt

SEQ ID NO: 18749 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (7)..(7): base is a locked nucleic acid
ccaaagycrggagtagt

SEQ ID NO: 18750 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
ccaaagycrggagtagt

SEQ ID NO: 18751 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (14)..(14): base is a locked nucleic acid
ccaaagycrggagtagt

SEQ ID NO: 18752 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (16)..(16): base is a locked nucleic acid
ccaaagycrggagtagt

SEQ ID NO: 18753 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (12)..(12): base is a locked nucleic acid
ccaaagycrggagtagt

SEQ ID NO: 18754 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (10)..(10): base is a locked nucleic acid
ccaaagycrggagtagt

SEQ ID NO: 18755 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (7)..(7): base is a locked nucleic acid
  modified_base (8)..(8): base is a locked nucleic acid
  modified_base (9)..(9): base is a locked nucleic acid
ccaaagycrggagtagt

SEQ ID NO: 18756 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (2)..(2): base is a locked nucleic acid
  modified_base (8)..(8): base is a locked nucleic acid
  modified_base (9)..(9): base is a locked nucleic acid
ccaaagycrggagtagt

SEQ ID NO: 18757 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (6)..(6): base is a locked nucleic acid
  modified_base (8)..(8): base is a locked nucleic acid
  modified_base (9)..(9): base is a locked nucleic acid
ccaaagycrggagtagt

SEQ ID NO: 18758 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (1)..(1): base is a locked nucleic acid
  modified_base (8)..(8): base is a locked nucleic acid
  modified_base (9)..(9): base is a locked nucleic acid
ccaaagycrggagtagt

SEQ ID NO: 18759 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (12)..(12): base is a locked nucleic acid
ccaaagycrggagtagt

SEQ ID NO: 18760 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (10)..(10): base is a locked nucleic acid
ccaaagycrggagtagt

SEQ ID NO: 18761 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (14)..(14): base is a locked nucleic acid
ccaaagycrggagtagt

SEQ ID NO: 18762 - DNA, 17 bp, Artificial Sequence
  Oligonucleotide probe
  misc_binding (1)..(17): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (15)..(15): base is a locked nucleic acid
ccaaagycrggagtagt

SEQ ID NO: 18763 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
caaagycaggagtag

SEQ ID NO: 18764 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (5)..(5): base is a locked nucleic acid
caaagycaggagtag

SEQ ID NO: 18765 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (3)..(3): base is a locked nucleic acid
caaagycaggagtag

SEQ ID NO: 18766 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (1)..(1): base is a locked nucleic acid
caaagycaggagtag

SEQ ID NO: 18767 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (2)..(2): base is a locked nucleic acid
caaagycaggagtag

SEQ ID NO: 18768 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (14)..(14): base is a locked nucleic acid
caaagycaggagtag

SEQ ID NO: 18769 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (15)..(15): base is a locked nucleic acid
caaagycaggagtag

SEQ ID NO: 18770 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (12)..(12): base is a locked nucleic acid
caaagycaggagtag

SEQ ID NO: 18771 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (10)..(10): base is a locked nucleic acid
caaagycaggagtag

SEQ ID NO: 18772 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (7)..(7): base is a locked nucleic acid
  modified_base (8)..(8): base is a locked nucleic acid
  modified_base (9)..(9): base is a locked nucleic acid
caaagycaggagtag

SEQ ID NO: 18773 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (3)..(3): base is a locked nucleic acid
  modified_base (8)..(8): base is a locked nucleic acid
  modified_base (9)..(9): base is a locked nucleic acid
caaagycaggagtag

SEQ ID NO: 18774 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (2)..(2): base is a locked nucleic acid
  modified_base (8)..(8): base is a locked nucleic acid
  modified_base (9)..(9): base is a locked nucleic acid
caaagycaggagtag

SEQ ID NO: 18775 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (4)..(4): base is a locked nucleic acid
  modified_base (8)..(8): base is a locked nucleic acid
  modified_base (9)..(9): base is a locked nucleic acid
caaagycaggagtag

SEQ ID NO: 18776 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (11)..(11): base is a locked nucleic acid
caaagycaggagtag

SEQ ID NO: 18777 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (13)..(13): base is a locked nucleic acid
caaagycaggagtag

SEQ ID NO: 18778 - DNA, 16 bp, Artificial Sequence
  Oligonucleotide probe
  misc_binding (1)..(16): Hybridization probe for the specific detection of mutant HIV-1 at codon 148 of the integrase gene.
  modified_base (8)..(8): base is a locked nucleic acid
  modified_base (9)..(9): base is a locked nucleic acid
caaagycaggagtagt

SEQ ID NO: 18779 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (14)..(14): base is a locked nucleic acid
caaagycaggagtag

SEQ ID NO: 18780 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
cccaaagyarggagt

SEQ ID NO: 18781 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (3)..(3): base is a locked nucleic acid
cccaaagyarggagt

SEQ ID NO: 18782 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (5)..(5): base is a locked nucleic acid
cccaaagyarggagt

SEQ ID NO: 18783 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
cccaaagyarggagt

SEQ ID NO: 18784 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (7)..(7): base is a locked nucleic acid
cccaaagyarggagt

SEQ ID NO: 18785 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (15)..(15): base is a locked nucleic acid
cccaaagyarggagt

SEQ ID NO: 18786 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (12)..(12): base is a locked nucleic acid
cccaaagyarggagt

SEQ ID NO: 18787 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (9)..(9): base is a locked nucleic acid
cccaaagyarggagt

SEQ ID NO: 18788 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (11)..(11): base is a locked nucleic acid
cccaaagyarggagt

SEQ ID NO: 18789 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (3)..(3): base is a locked nucleic acid
  modified_base (8)..(8): base is a locked nucleic acid
  modified_base (9)..(9): base is a locked nucleic acid
cccaaagyarggagt

SEQ ID NO: 18790 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (5)..(5): base is a locked nucleic acid
  modified_base (8)..(8): base is a locked nucleic acid
  modified_base (9)..(9): base is a locked nucleic acid
cccaaagyarggagt

SEQ ID NO: 18791 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (2)..(2): base is a locked nucleic acid
  modified_base (8)..(8): base is a locked nucleic acid
  modified_base (9)..(9): base is a locked nucleic acid
cccaaagyarggagt

SEQ ID NO: 18792 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (4)..(4): base is a locked nucleic acid
  modified_base (8)..(8): base is a locked nucleic acid
  modified_base (9)..(9): base is a locked nucleic acid
cccaaagyarggagt

SEQ ID NO: 18793 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (11)..(11): base is a locked nucleic acid
cccaaagyarggagt

SEQ ID NO: 18794 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (14)..(14): base is a locked nucleic acid
cccaaagyarggagt

SEQ ID NO: 18795 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (15)..(15): base is a locked nucleic acid
cccaaagyarggagt

SEQ ID NO: 18796 - DNA, 16 bp, Artificial Sequence
  Oligonucleotide probe
  misc_binding (1)..(16): Hybridization probe for the specific detection of mutant HIV-1 at codon 148 of the integrase gene.
  modified_base (8)..(8): base is a locked nucleic acid
  modified_base (9)..(9): base is a locked nucleic acid
cccaaagyarggagta

SEQ ID NO: 18797 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
ccaaagycrggagta

SEQ ID NO: 18798 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (5)..(5): base is a locked nucleic acid
ccaaagycrggagta

SEQ ID NO: 18799 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (3)..(3): base is a locked nucleic acid
ccaaagycrggagta

SEQ ID NO: 18800 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (7)..(7): base is a locked nucleic acid
ccaaagycrggagta

SEQ ID NO: 18801 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
ccaaagycrggagta

SEQ ID NO: 18802 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (14)..(14): base is a locked nucleic acid
ccaaagycrggagta

SEQ ID NO: 18803 - DNA, 15 bp, Artificial Sequence
  Oligonucleotide probe
  misc_binding (1)..(15): Hybridization probe for the specific detection of mutant HIV-1 at codon 148 of the integrase gene.
ccaaagycrggagta

SEQ ID NO: 18804 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (12)..(12): base is a locked nucleic acid
ccaaagycrggagta

SEQ ID NO: 18805 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (10)..(10): base is a locked nucleic acid
ccaaagycrggagta

SEQ ID NO: 18806 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (7)..(7): base is a locked nucleic acid
  modified_base (8)..(8): base is a locked nucleic acid
  modified_base (9)..(9): base is a locked nucleic acid
ccaaagycrggagta

SEQ ID NO: 18807 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (2)..(2): base is a locked nucleic acid
  modified_base (8)..(8): base is a locked nucleic acid
  modified_base (9)..(9): base is a locked nucleic acid
ccaaagycrggagta

SEQ ID NO: 18808 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (6)..(6): base is a locked nucleic acid
  modified_base (8)..(8): base is a locked nucleic acid
  modified_base (9)..(9): base is a locked nucleic acid
ccaaagycrggagta

SEQ ID NO: 18809 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (1)..(1): base is a locked nucleic acid
  modified_base (8)..(8): base is a locked nucleic acid
  modified_base (9)..(9): base is a locked nucleic acid
ccaaagycrggagta

SEQ ID NO: 18810 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (12)..(12): base is a locked nucleic acid
ccaaagycrggagta

SEQ ID NO: 18811 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (10)..(10): base is a locked nucleic acid
ccaaagycrggagta

SEQ ID NO: 18812 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (14)..(14): base is a locked nucleic acid
ccaaagycrggagta

SEQ ID NO: 18813 - DNA, 15 bp, Artificial Sequence
  Oligonucleotide probe
  misc_binding (1)..(15): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (15)..(15): base is a locked nucleic acid
ccaaagycrggagta

SEQ ID NO: 18814 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
caaagycaggagt

SEQ ID NO: 18815 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (5)..(5): base is a locked nucleic acid
caaagycaggagt

SEQ ID NO: 18816 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (3)..(3): base is a locked nucleic acid
caaagycaggagt

SEQ ID NO: 18817 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (1)..(1): base is a locked nucleic acid
caaagycaggagt

SEQ ID NO: 18818 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (2)..(2): base is a locked nucleic acid
caaagycaggagt

SEQ ID NO: 18819 - DNA, 13 bp, Artificial Sequence
  Oligonucleotide probe
  misc_binding (1)..(13): Hybridization probe for the specific detection of mutant HIV-1 at codon 148 of the integrase gene.
caaagycaggagt

SEQ ID NO: 18820 - DNA, 14 bp, Artificial Sequence
  Oligonucleotide probe
  misc_binding (1)..(14): Hybridization probe for the specific detection of mutant HIV-1 at codon 148 of the integrase gene.
caaagycaggagta

SEQ ID NO: 18821 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (12)..(12): base is a locked nucleic acid
caaagycaggagt

SEQ ID NO: 18822 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (10)..(10): base is a locked nucleic acid
caaagycaggagt

SEQ ID NO: 18823 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (7)..(7): base is a locked nucleic acid
  modified_base (8)..(8): base is a locked nucleic acid
  modified_base (9)..(9): base is a locked nucleic acid
caaagycaggagt

SEQ ID NO: 18824 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (3)..(3): base is a locked nucleic acid
  modified_base (8)..(8): base is a locked nucleic acid
  modified_base (9)..(9): base is a locked nucleic acid
caaagycaggagt

SEQ ID NO: 18825 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (2)..(2): base is a locked nucleic acid
  modified_base (8)..(8): base is a locked nucleic acid
  modified_base (9)..(9): base is a locked nucleic acid
caaagycaggagt

SEQ ID NO: 18826 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (4)..(4): base is a locked nucleic acid
  modified_base (8)..(8): base is a locked nucleic acid
  modified_base (9)..(9): base is a locked nucleic acid
caaagycaggagt

SEQ ID NO: 18827 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (11)..(11): base is a locked nucleic acid
caaagycaggagt

SEQ ID NO: 18828 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (13)..(13): base is a locked nucleic acid
caaagycaggagt

SEQ ID NO: 18829 - DNA, 14 bp, Artificial Sequence
  Oligonucleotide probe
  misc_binding (1)..(14): Hybridization probe for the specific detection of mutant HIV-1 at codon 148 of the integrase gene.
  modified_base (8)..(8): base is a locked nucleic acid
  modified_base (9)..(9): base is a locked nucleic acid
caaagycaggagta

SEQ ID NO: 18830 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
caaagycaggagt

SEQ ID NO: 18831 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
cccaaagyargga

SEQ ID NO: 18832 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (3)..(3): base is a locked nucleic acid
cccaaagyargga

SEQ ID NO: 18833 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (5)..(5): base is a locked nucleic acid
cccaaagyargga

SEQ ID NO: 18834 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
cccaaagyargga

SEQ ID NO: 18835 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (7)..(7): base is a locked nucleic acid
cccaaagyargga

SEQ ID NO: 18836 - DNA, 14 bp, Artificial Sequence
  Oligonucleotide probe
  misc_binding (1)..(14): Hybridization probe for the specific detection of mutant HIV-1 at codon 148 of the integrase gene.
cccaaagyarggag

SEQ ID NO: 18837 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (12)..(12): base is a locked nucleic acid
cccaaagyargga

SEQ ID NO: 18838 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (9)..(9): base is a locked nucleic acid
cccaaagyargga

SEQ ID NO: 18839 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (11)..(11): base is a locked nucleic acid
cccaaagyargga

SEQ ID NO: 18840 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (3)..(3): base is a locked nucleic acid
  modified_base (8)..(8): base is a locked nucleic acid
  modified_base (9)..(9): base is a locked nucleic acid
cccaaagyargga

SEQ ID NO: 18841 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (5)..(5): base is a locked nucleic acid
  modified_base (8)..(8): base is a locked nucleic acid
  modified_base (9)..(9): base is a locked nucleic acid
cccaaagyargga

SEQ ID NO: 18842 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (2)..(2): base is a locked nucleic acid
  modified_base (8)..(8): base is a locked nucleic acid
  modified_base (9)..(9): base is a locked nucleic acid
cccaaagyargga

SEQ ID NO: 18843 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (4)..(4): base is a locked nucleic acid
  modified_base (8)..(8): base is a locked nucleic acid
  modified_base (9)..(9): base is a locked nucleic acid
cccaaagyargga

SEQ ID NO: 18844 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (11)..(11): base is a locked nucleic acid
cccaaagyargga

SEQ ID NO: 18845 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
cccaaagyargga

SEQ ID NO: 18846 - DNA, 14 bp, Artificial Sequence
  Oligonucleotide probe
  misc_binding (1)..(14): Hybridization probe for the specific detection of mutant HIV-1 at codon 148 of the integrase gene.
  modified_base (8)..(8): base is a locked nucleic acid
  modified_base (9)..(9): base is a locked nucleic acid
cccaaagyarggag

SEQ ID NO: 18847 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
ccaaagycrggag

SEQ ID NO: 18848 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (5)..(5): base is a locked nucleic acid
ccaaagycrggag

SEQ ID NO: 18849 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (3)..(3): base is a locked nucleic acid
ccaaagycrggag

SEQ ID NO: 18850 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (7)..(7): base is a locked nucleic acid
ccaaagycrggag

SEQ ID NO: 18851 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
ccaaagycrggag

SEQ ID NO: 18852 - DNA, 13 bp, Artificial Sequence
  Oligonucleotide probe
  misc_binding (1)..(13): Hybridization probe for the specific detection of mutant HIV-1 at codon 148 of the integrase gene.
ccaaagycrggag

SEQ ID NO: 18853 - DNA, 14 bp, Artificial Sequence
  Oligonucleotide probe
  misc_binding (1)..(14): Hybridization probe for the specific detection of mutant HIV-1 at codon 148 of the integrase gene.
ccaaagycrggagt

SEQ ID NO: 18854 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (12)..(12): base is a locked nucleic acid
ccaaagycrggag

SEQ ID NO: 18855 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (10)..(10): base is a locked nucleic acid
ccaaagycrggag

SEQ ID NO: 18856 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (7)..(7): base is a locked nucleic acid
  modified_base (8)..(8): base is a locked nucleic acid
  modified_base (9)..(9): base is a locked nucleic acid
ccaaagycrggag

SEQ ID NO: 18857 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (2)..(2): base is a locked nucleic acid
  modified_base (8)..(8): base is a locked nucleic acid
  modified_base (9)..(9): base is a locked nucleic acid
ccaaagycrggag

SEQ ID NO: 18858 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (6)..(6): base is a locked nucleic acid
  modified_base (8)..(8): base is a locked nucleic acid
  modified_base (9)..(9): base is a locked nucleic acid
ccaaagycrggag

SEQ ID NO: 18859 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (1)..(1): base is a locked nucleic acid
  modified_base (8)..(8): base is a locked nucleic acid
  modified_base (9)..(9): base is a locked nucleic acid
ccaaagycrggag

SEQ ID NO: 18860 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (12)..(12): base is a locked nucleic acid
ccaaagycrggag

SEQ ID NO: 18861 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
  modified_base (10)..(10): base is a locked nucleic acid
ccaaagycrggag

SEQ ID NO: 18862 - DNA, 13 bp, Artificial Sequence
  Oligonucleotide probe
  misc_binding (1)..(13): Hybridization probe for the specific detection of mutant HIV-1 at codon 148 of the integrase gene.
  modified_base (8)..(8): base is a locked nucleic acid
  modified_base (9)..(9): base is a locked nucleic acid
ccaaagycrggag

SEQ ID NO: 18863 - DNA, 14 bp, Artificial Sequence
  Oligonucleotide probe
  misc_binding (1)..(14): Hybridization probe for the specific detection of mutant HIV-1 at codon 148 of the integrase gene.
  modified_base (8)..(8): base is a locked nucleic acid
  modified_base (9)..(9): base is a locked nucleic acid
ccaaagycrggagt

SEQ ID NO: 18864 - DNA, 18 bp, Artificial Sequence
  Oligonucleotide probe
  misc_binding (1)..(18): Hybridization probe for the specific detection of mutant HIV-1 at codon 148 of the integrase gene.
ccaaagycaggagtagtr

SEQ ID NO: 18865 - DNA, 18 bp, Artificial Sequence
  Oligonucleotide probe
  misc_binding (1)..(18): Hybridization probe for the specific detection of mutant HIV-1 at codon 148 of the integrase gene.
ccccaaagyarggagtag

SEQ ID NO: 18866 - DNA, 18 bp, Artificial Sequence
  Oligonucleotide probe
  misc_binding (1)..(18): Hybridization probe for the specific detection of mutant HIV-1 at codon 148 of the integrase gene.
cccaaagycrggagtagt

SEQ ID NO: 18867 - DNA, 17 bp, Artificial Sequence
  Oligonucleotide probe
  misc_binding (1)..(17): Hybridization probe for the specific detection of mutant HIV-1 at codon 148 of the integrase gene.
caaagycaggagtagtr

SEQ ID NO: 18868 - DNA, 17 bp, Artificial Sequence
  Oligonucleotide probe
  misc_binding (1)..(17): Hybridization probe for the specific detection of mutant HIV-1 at codon 148 of the integrase gene.
cccaaagyarggagtag

SEQ ID NO: 18869 - DNA, 17 bp, Artificial Sequence
  Oligonucleotide probe
  misc_binding (1)..(17): Hybridization probe for the specific detection of mutant HIV-1 at codon 148 of the integrase gene.
ccaaagycrggagtagt

SEQ ID NO: 18870 - DNA, 15 bp, Artificial Sequence
  Oligonucleotide probe
  misc_binding (1)..(15): Hybridization probe for the specific detection of mutant HIV-1 at codon 148 of the integrase gene.
caaagycaggagtag

SEQ ID NO: 18871 - DNA, 16 bp, Artificial Sequence
  Oligonucleotide probe
  misc_binding (1)..(16): Hybridization probe for the specific detection of mutant HIV-1 at codon 148 of the integrase gene.
caaagycaggagtagt

SEQ ID NO: 18872 - DNA, 15 bp, Artificial Sequence
  Oligonucleotide probe
  misc_binding (1)..(15): Hybridization probe for the specific detection of mutant HIV-1 at codon 148 of the integrase gene.
cccaaagyarggagt

SEQ ID NO: 18873 - DNA, 16 bp, Artificial Sequence
  Oligonucleotide probe
  misc_binding (1)..(16): Hybridization probe for the specific detection of mutant HIV-1 at codon 148 of the integrase gene.
cccaaagyarggagta

SEQ ID NO: 18874 - DNA, 15 bp, Artificial Sequence
  Oligonucleotide probe
  misc_binding (1)..(15): Hybridization probe for the specific detection of mutant HIV-1 at codon 148 of the integrase gene.
ccaaagycrggagta

SEQ ID NO: 18875 - DNA, 13 bp, Artificial Sequence
  Oligonucleotide probe
  misc_binding (1)..(13): Hybridization probe for the specific detection of mutant HIV-1 at codon 148 of the integrase gene.
caaagycaggagt

SEQ ID NO: 18876 - DNA, 13 bp, Artificial Sequence
  Oligonucleotide probe
  misc_binding (1)..(13): Hybridization probe for the specific detection of mutant HIV-1 at codon 148 of the integrase gene.
cccaaagyargga

SEQ ID NO: 18877 - DNA, 13 bp, Artificial Sequence
  Oligonucleotide probe
  misc_binding (1)..(13): Hybridization probe for the specific detection of mutant HIV-1 at codon 148 of the integrase gene.
ccaaagycrggag

SEQ ID NO: 18878 - DNA, 15 bp, Artificial Sequence
  Oligonucleotide probe
  misc_binding (1)..(15): Hybridization probe for the specific detection of mutant HIV-1 at codon 148 of the integrase gene.
caaagtcayggagta

SEQ ID NO: 18879 - DNA, 15 bp, Artificial Sequence
  Oligonucleotide probe
  misc_binding (1)..(15): Hybridization probe for the specific detection of mutant HIV-1 at codon 148 of the integrase gene.
caaagtmgrggagta

SEQ ID NO: 18880 - DNA, 15 bp, Artificial Sequence
  Oligonucleotide probe
  misc_binding (1)..(15): Hybridization probe for the specific detection of mutant HIV-1 at codon 148 of the integrase gene.
caaagtaarggagta

SEQ ID NO: 18881 - DNA, 15 bp, Artificial Sequence
  Oligonucleotide probe
  misc_binding (1)..(15): Hybridization probe for the specific detection of mutant HIV-1 at codon 153 of the integrase gene.
attcatrtattctac

SEQ ID NO: 18882 - DNA, 15 bp, Artificial Sequence
  Oligonucleotide probe
  misc_binding (1)..(15): Hybridization probe for the specific detection of mutant HIV-1 at codon 153 of the integrase gene.
attcatraattctac

SEQ ID NO: 18883 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
  modified_base (10)..(10): base is a locked nucleic acid
gartcyatgataargaat

SEQ ID NO: 18884 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
gartcyatgataargaat

SEQ ID NO: 18885 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (2)..(2): base is a locked nucleic acid
gartcyatgataargaat

SEQ ID NO: 18886 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (7)..(7): base is a locked nucleic acid
gartcyatgataargaat

SEQ ID NO: 18887 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (5)..(5): base is a locked nucleic acid
gartcyatgataargaat

SEQ ID NO: 18888 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (15)..(15): base is a locked nucleic acid
gartcyatgataargaat

SEQ ID NO: 18889 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (17)..(17): base is a locked nucleic acid
gartcyatgataargaat

SEQ ID NO: 18890 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (14)..(14): base is a locked nucleic acid
gartcyatgataargaat

SEQ ID NO: 18891 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (11)..(11): base is a locked nucleic acid
gartcyatgataargaat

SEQ ID NO: 18892 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (10)..(10): base is a locked nucleic acid
gartcyatgataargaat

SEQ ID NO: 18893 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (2)..(2): base is a locked nucleic acid
  modified_base (9)..(9): base is a locked nucleic acid
  modified_base (10)..(10): base is a locked nucleic acid
gartcyatgataargaat

SEQ ID NO: 18894 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (4)..(4): base is a locked nucleic acid
  modified_base (9)..(9): base is a locked nucleic acid
  modified_base (10)..(10): base is a locked nucleic acid
gartcyatgataargaat

SEQ ID NO: 18895 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (5)..(5): base is a locked nucleic acid
  modified_base (9)..(9): base is a locked nucleic acid
  modified_base (10)..(10): base is a locked nucleic acid
gartcyatgataargaat

SEQ ID NO: 18896 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
  modified_base (10)..(10): base is a locked nucleic acid
  modified_base (12)..(12): base is a locked nucleic acid
gartcyatgataargaat

SEQ ID NO: 18897 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
  modified_base (10)..(10): base is a locked nucleic acid
  modified_base (13)..(13): base is a locked nucleic acid
gartcyatgataargaat

SEQ ID NO: 18898 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
  modified_base (10)..(10): base is a locked nucleic acid
  modified_base (17)..(17): base is a locked nucleic acid
gartcyatgataargaat

SEQ ID NO: 18899 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
  modified_base (10)..(10): base is a locked nucleic acid
  modified_base (16)..(16): base is a locked nucleic acid
gartcyatgataargaat

SEQ ID NO: 18900 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
  modified_base (10)..(10): base is a locked nucleic acid
artcyatgataargaatt

SEQ ID NO: 18901 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (4)..(4): base is a locked nucleic acid
artcyatgataargaatt

SEQ ID NO: 18902 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (6)..(6): base is a locked nucleic acid
artcyatgataargaatt

SEQ ID NO: 18903 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (3)..(3): base is a locked nucleic acid
artcyatgataargaatt

SEQ ID NO: 18904 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (2)..(2): base is a locked nucleic acid
artcyatgataargaatt

SEQ ID NO: 18905 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (18)..(18): base is a locked nucleic acid
artcyatgataargaatt

SEQ ID NO: 18906 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (10)..(10): base is a locked nucleic acid
artcyatgataargaatt

SEQ ID NO: 18907 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (14)..(14): base is a locked nucleic acid
artcyatgataargaatt

SEQ ID NO: 18908 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (15)..(15): base is a locked nucleic acid
artcyatgataargaatt

SEQ ID NO: 18909 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (3)..(3): base is a locked nucleic acid
  modified_base (9)..(9): base is a locked nucleic acid
  modified_base (10)..(10): base is a locked nucleic acid
artcyatgataargaatt

SEQ ID NO: 18910 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (7)..(7): base is a locked nucleic acid
  modified_base (9)..(9): base is a locked nucleic acid
  modified_base (10)..(10): base is a locked nucleic acid
artcyatgataargaatt

SEQ ID NO: 18911 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (6)..(6): base is a locked nucleic acid
  modified_base (9)..(9): base is a locked nucleic acid
  modified_base (10)..(10): base is a locked nucleic acid
artcyatgataargaatt

SEQ ID NO: 18912 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (10)..(10): base is a locked nucleic acid
artcyatgataargaatt

SEQ ID NO: 18913 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
  modified_base (10)..(10): base is a locked nucleic acid
  modified_base (14)..(14): base is a locked nucleic acid
artcyatgataargaatt

SEQ ID NO: 18914 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
  modified_base (10)..(10): base is a locked nucleic acid
  modified_base (16)..(16): base is a locked nucleic acid
artcyatgataargaatt

SEQ ID NO: 18915 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
  modified_base (10)..(10): base is a locked nucleic acid
  modified_base (17)..(17): base is a locked nucleic acid
artcyatgataargaatt

SEQ ID NO: 18916 - DNA, 18 bp, Artificial Sequence
  Oligonucleotide probe
  misc_binding (1)..(18): Hybridization probe for the specific detection of mutant HIV-1 at codon 155 of the integrase gene.
  modified_base (9)..(9): base is a locked nucleic acid
  modified_base (10)..(10): base is a locked nucleic acid
  modified_base (12)..(12): base is a locked nucleic acid
artcyatgataargaatt

SEQ ID NO: 18917 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
  modified_base (9)..(9): base is a locked nucleic acid
artcyatgataargaat

SEQ ID NO: 18918 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
artcyatgataargaat

SEQ ID NO: 18919 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (1)..(1): base is a locked nucleic acid
artcyatgataargaat

SEQ ID NO: 18920 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (6)..(6): base is a locked nucleic acid
artcyatgataargaat

SEQ ID NO: 18921 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (4)..(4): base is a locked nucleic acid
artcyatgataargaat

SEQ ID NO: 18922 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (14)..(14): base is a locked nucleic acid
artcyatgataargaat

SEQ ID NO: 18923 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (16)..(16): base is a locked nucleic acid
artcyatgataargaat

SEQ ID NO: 18924 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (13)..(13): base is a locked nucleic acid
artcyatgataargaat

SEQ ID NO: 18925 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (10)..(10): base is a locked nucleic acid
artcyatgataargaat

SEQ ID NO: 18926 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (7)..(7): base is a locked nucleic acid
  modified_base (8)..(8): base is a locked nucleic acid
  modified_base (9)..(9): base is a locked nucleic acid
artcyatgataargaat

SEQ ID NO: 18927 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (1)..(1): base is a locked nucleic acid
  modified_base (8)..(8): base is a locked nucleic acid
  modified_base (9)..(9): base is a locked nucleic acid
artcyatgataargaat

SEQ ID NO: 18928 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (3)..(3): base is a locked nucleic acid
  modified_base (8)..(8): base is a locked nucleic acid
  modified_base (9)..(9): base is a locked nucleic acid
artcyatgataargaat

SEQ ID NO: 18929 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (4)..(4): base is a locked nucleic acid
  modified_base (8)..(8): base is a locked nucleic acid
  modified_base (9)..(9): base is a locked nucleic acid
artcyatgataargaat

SEQ ID NO: 18930 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (11)..(11): base is a locked nucleic acid
artcyatgataargaat

SEQ ID NO: 18931 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (12)..(12): base is a locked nucleic acid
artcyatgataargaat

SEQ ID NO: 18932 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (16)..(16): base is a locked nucleic acid
artcyatgataargaat

SEQ ID NO: 18933 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (15)..(15): base is a locked nucleic acid
artcyatgataargaat

SEQ ID NO: 18934 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
  modified_base (9)..(9): base is a locked nucleic acid
rtcyatgataargaatt

SEQ ID NO: 18935 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (3)..(3): base is a locked nucleic acid
rtcyatgataargaatt

SEQ ID NO: 18936 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (5)..(5): base is a locked nucleic acid
rtcyatgataargaatt

SEQ ID NO: 18937 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (2)..(2): base is a locked nucleic acid
rtcyatgataargaatt

SEQ ID NO: 18938 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (1)..(1): base is a locked nucleic acid
rtcyatgataargaatt

SEQ ID NO: 18939 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (17)..(17): base is a locked nucleic acid
rtcyatgataargaatt

SEQ ID NO: 18940 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (9)..(9): base is a locked nucleic acid
rtcyatgataargaatt

SEQ ID NO: 18941 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (13)..(13): base is a locked nucleic acid
rtcyatgataargaatt

SEQ ID NO: 18942 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (14)..(14): base is a locked nucleic acid
rtcyatgataargaatt

SEQ ID NO: 18943 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (2)..(2): base is a locked nucleic acid
  modified_base (8)..(8): base is a locked nucleic acid
  modified_base (9)..(9): base is a locked nucleic acid
rtcyatgataargaatt

SEQ ID NO: 18944 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (6)..(6): base is a locked nucleic acid
  modified_base (8)..(8): base is a locked nucleic acid
  modified_base (9)..(9): base is a locked nucleic acid
rtcyatgataargaatt

SEQ ID NO: 18945 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (5)..(5): base is a locked nucleic acid
  modified_base (8)..(8): base is a locked nucleic acid
  modified_base (9)..(9): base is a locked nucleic acid
rtcyatgataargaatt

SEQ ID NO: 18946 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (7)..(7): base is a locked nucleic acid
  modified_base (8)..(8): base is a locked nucleic acid
  modified_base (9)..(9): base is a locked nucleic acid
rtcyatgataargaatt

SEQ ID NO: 18947 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (13)..(13): base is a locked nucleic acid
rtcyatgataargaatt

SEQ ID NO: 18948 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (15)..(15): base is a locked nucleic acid
rtcyatgataargaatt

SEQ ID NO: 18949 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (16)..(16): base is a locked nucleic acid
rtcyatgataargaatt

SEQ ID NO: 18950 - DNA, 17 bp, Artificial Sequence
  Oligonucleotide probe
  misc_binding (1)..(17): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (11)..(11): base is a locked nucleic acid
rtcyatgataargaatt

SEQ ID NO: 18951 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
  modified_base (9)..(9): base is a locked nucleic acid
artcyatgataarga

SEQ ID NO: 18952 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
artcyatgataarga

SEQ ID NO: 18953 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (1)..(1): base is a locked nucleic acid
artcyatgataarga

SEQ ID NO: 18954 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (6)..(6): base is a locked nucleic acid
artcyatgataarga

SEQ ID NO: 18955 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (4)..(4): base is a locked nucleic acid
artcyatgataarga

SEQ ID NO: 18956 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (14)..(14): base is a locked nucleic acid
artcyatgataarga

SEQ ID NO: 18957 - DNA, 15 bp, Artificial Sequence
  Oligonucleotide probe
  misc_binding (1)..(15): Hybridization probe for the specific detection of mutant HIV-1 at codon 155 of the integrase gene.
artcyatgataarga

SEQ ID NO: 18958 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (13)..(13): base is a locked nucleic acid
artcyatgataarga

SEQ ID NO: 18959 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (10)..(10): base is a locked nucleic acid
artcyatgataarga

SEQ ID NO: 18960 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (7)..(7): base is a locked nucleic acid
  modified_base (8)..(8): base is a locked nucleic acid
  modified_base (9)..(9): base is a locked nucleic acid
artcyatgataarga

SEQ ID NO: 18961 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (1)..(1): base is a locked nucleic acid
  modified_base (8)..(8): base is a locked nucleic acid
  modified_base (9)..(9): base is a locked nucleic acid
artcyatgataarga

SEQ ID NO: 18962 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (3)..(3): base is a locked nucleic acid
  modified_base (8)..(8): base is a locked nucleic acid
  modified_base (9)..(9): base is a locked nucleic acid
artcyatgataarga

SEQ ID NO: 18963 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (4)..(4): base is a locked nucleic acid
  modified_base (8)..(8): base is a locked nucleic acid
  modified_base (9)..(9): base is a locked nucleic acid
artcyatgataarga

SEQ ID NO: 18964 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (11)..(11): base is a locked nucleic acid
artcyatgataarga

SEQ ID NO: 18965 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (12)..(12): base is a locked nucleic acid
artcyatgataarga

SEQ ID NO: 18966 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
  modified_base (9)..(9): base is a locked nucleic acid
artcyatgataarga

SEQ ID NO: 18967 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (15)..(15): base is a locked nucleic acid
artcyatgataarga

SEQ ID NO: 18968 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
  modified_base (9)..(9): base is a locked nucleic acid
rtcyatgataargaa

SEQ ID NO: 18969 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (3)..(3): base is a locked nucleic acid
rtcyatgataargaa

SEQ ID NO: 18970 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (5)..(5): base is a locked nucleic acid
rtcyatgataargaa

SEQ ID NO: 18971 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (2)..(2): base is a locked nucleic acid
rtcyatgataargaa

SEQ ID NO: 18972 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (1)..(1): base is a locked nucleic acid
rtcyatgataargaa

SEQ ID NO: 18973 - DNA, 16 bp, Artificial Sequence
  Oligonucleotide probe
  misc_binding (1)..(16): Hybridization probe for the specific detection of mutant HIV-1 at codon 155 of the integrase gene.
rtcyatgataargaat

SEQ ID NO: 18974 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (9)..(9): base is a locked nucleic acid
rtcyatgataargaa

SEQ ID NO: 18975 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (13)..(13): base is a locked nucleic acid
rtcyatgataargaa

SEQ ID NO: 18976 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (14)..(14): base is a locked nucleic acid
rtcyatgataargaa

SEQ ID NO: 18977 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (2)..(2): base is a locked nucleic acid
  modified_base (8)..(8): base is a locked nucleic acid
  modified_base (9)..(9): base is a locked nucleic acid
rtcyatgataargaa

SEQ ID NO: 18978 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (6)..(6): base is a locked nucleic acid
  modified_base (8)..(8): base is a locked nucleic acid
  modified_base (9)..(9): base is a locked nucleic acid
rtcyatgataargaa

SEQ ID NO: 18979 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (5)..(5): base is a locked nucleic acid
  modified_base (8)..(8): base is a locked nucleic acid
  modified_base (9)..(9): base is a locked nucleic acid
rtcyatgataargaa

SEQ ID NO: 18980 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (7)..(7): base is a locked nucleic acid
  modified_base (8)..(8): base is a locked nucleic acid
  modified_base (9)..(9): base is a locked nucleic acid
rtcyatgataargaa

SEQ ID NO: 18981 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (13)..(13): base is a locked nucleic acid
rtcyatgataargaa

SEQ ID NO: 18982 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (15)..(15): base is a locked nucleic acid
rtcyatgataargaa

SEQ ID NO: 18983 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
  modified_base (9)..(9): base is a locked nucleic acid
rtcyatgataargaa

SEQ ID NO: 18984 - DNA, 15 bp, Artificial Sequence
  Oligonucleotide probe
  misc_binding (1)..(15): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (11)..(11): base is a locked nucleic acid
rtcyatgataargaa

SEQ ID NO: 18985 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (8)..(8): base is a locked nucleic acid
  modified_base (9)..(9): base is a locked nucleic acid
artcyatgataar

SEQ ID NO: 18986 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (8)..(8): base is a locked nucleic acid
artcyatgataar

SEQ ID NO: 18987 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (1)..(1): base is a locked nucleic acid
artcyatgataar

SEQ ID NO: 18988 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (6)..(6): base is a locked nucleic acid
artcyatgataar

SEQ ID NO: 18989 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (4)..(4): base is a locked nucleic acid
artcyatgataar

SEQ ID NO: 18990 - DNA, 13 bp, Artificial Sequence
  Oligonucleotide probe
  misc_binding (1)..(13): Hybridization probe for the specific detection of mutant HIV-1 at codon 155 of the integrase gene.
artcyatgataar

SEQ ID NO: 18991 - DNA, 14 bp, Artificial Sequence
  Oligonucleotide probe
  misc_binding (1)..(14): Hybridization probe for the specific detection of mutant HIV-1 at codon 155 of the integrase gene.
artcyatgataarg

SEQ ID NO: 18992 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (13)..(13): base is a locked nucleic acid
artcyatgataar

SEQ ID NO: 18993 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (10)..(10): base is a locked nucleic acid
artcyatgataar

SEQ ID NO: 18994 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (7)..(7): base is a locked nucleic acid
  modified_base (8)..(8): base is a locked nucleic acid
  modified_base (9)..(9): base is a locked nucleic acid
artcyatgataar

SEQ ID NO: 18995 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (1)..(1): base is a locked nucleic acid
  modified_base (8)..(8): base is a locked nucleic acid
  modified_base (9)..(9): base is a locked nucleic acid
artcyatgataar

SEQ ID NO: 18996 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (3)..(3): base is a locked nucleic acid
  modified_base (8)..(8): base is a locked nucleic acid
  modified_base (9)..(9): base is a locked nucleic acid
artcyatgataar

SEQ ID NO: 18997 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (4)..(4): base is a locked nucleic acid
  modified_base (8)..(8): base is a locked nucleic acid
  modified_base (9)..(9): base is a locked nucleic acid
artcyatgataar

SEQ ID NO: 18998 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (11)..(11): base is a locked nucleic acid
artcyatgataar

SEQ ID NO: 18999 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (12)..(12): base is a locked nucleic acid
artcyatgataar

SEQ ID NO: 19000 - DNA, 14 bp, Artificial Sequence
  Oligonucleotide probe
  misc_binding (1)..(14): Hybridization probe for the specific detection of mutant HIV-1 at codon 155 of the integrase gene.
  modified_base (8)..(8): base is a locked nucleic acid
  modified_base (9)..(9): base is a locked nucleic acid
artcyatgataarg

SEQ ID NO: 19001 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (8)..(8): base is a locked nucleic acid
  modified_base (9)..(9): base is a locked nucleic acid
rtcyatgataarg

SEQ ID NO: 19002 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (3)..(3): base is a locked nucleic acid
rtcyatgataarg

SEQ ID NO: 19003 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (5)..(5): base is a locked nucleic acid
rtcyatgataarg

SEQ ID NO: 19004 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (2)..(2): base is a locked nucleic acid
rtcyatgataarg

SEQ ID NO: 19005 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (1)..(1): base is a locked nucleic acid
rtcyatgataarg

SEQ ID NO: 19006 - DNA, 14 bp, Artificial Sequence
  Oligonucleotide probe
  misc_binding (1)..(14): Hybridization probe for the specific detection of mutant HIV-1 at codon 155 of the integrase gene.
rtcyatgataarga

SEQ ID NO: 19007 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (9)..(9): base is a locked nucleic acid
rtcyatgataarg

SEQ ID NO: 19008 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (13)..(13): base is a locked nucleic acid
rtcyatgataarg

SEQ ID NO: 19009 - DNA, 13 bp, Artificial Sequence
  Oligonucleotide probe
  misc_binding (1)..(13): Hybridization probe for the specific detection of mutant HIV-1 at codon 155 of the integrase gene.
rtcyatgataarg

SEQ ID NO: 19010 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (2)..(2): base is a locked nucleic acid
  modified_base (8)..(8): base is a locked nucleic acid
  modified_base (9)..(9): base is a locked nucleic acid
rtcyatgataarg

SEQ ID NO: 19011 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (6)..(6): base is a locked nucleic acid
  modified_base (8)..(8): base is a locked nucleic acid
  modified_base (9)..(9): base is a locked nucleic acid
rtcyatgataarg

SEQ ID NO: 19012 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (5)..(5): base is a locked nucleic acid
  modified_base (8)..(8): base is a locked nucleic acid
  modified_base (9)..(9): base is a locked nucleic acid
rtcyatgataarg

SEQ ID NO: 19013 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (7)..(7): base is a locked nucleic acid
  modified_base (8)..(8): base is a locked nucleic acid
  modified_base (9)..(9): base is a locked nucleic acid
rtcyatgataarg

SEQ ID NO: 19014 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (13)..(13): base is a locked nucleic acid
rtcyatgataarg

SEQ ID NO: 19015 - DNA, 14 bp, Artificial Sequence
  Oligonucleotide probe
  misc_binding (1)..(14): Hybridization probe for the specific detection of mutant HIV-1 at codon 155 of the integrase gene.
  modified_base (8)..(8): base is a locked nucleic acid
  modified_base (9)..(9): base is a locked nucleic acid
rtcyatgataarga

SEQ ID NO: 19016 - DNA, 13 bp, Artificial Sequence
  Oligonucleotide probe
  misc_binding (1)..(13): Hybridization probe for the specific detection of mutant HIV-1 at codon 155 of the integrase gene.
  modified_base (8)..(8): base is a locked nucleic acid
  modified_base (9)..(9): base is a locked nucleic acid
  modified_base (11)..(11): base is a locked nucleic acid
rtcyatgataarg

SEQ ID NO: 19017 - DNA, 18 bp, Artificial Sequence
  Oligonucleotide probe
  misc_binding (1)..(18): Hybridization probe for the specific detection of mutant HIV-1 at codon 155 of the integrase gene.
gartcyatgataargaat

SEQ ID NO: 19018 - DNA, 18 bp, Artificial Sequence
  Oligonucleotide probe
  misc_binding (1)..(18): Hybridization probe for the specific detection of mutant HIV-1 at codon 155 of the integrase gene.
artcyatgataargaatt

SEQ ID NO: 19019 - DNA, 17 bp, Artificial Sequence
  Oligonucleotide probe
  misc_binding (1)..(17): Hybridization probe for the specific detection of mutant HIV-1 at codon 155 of the integrase gene.
artcyatgataargaat

SEQ ID NO: 19020 - DNA, 17 bp, Artificial Sequence
  Oligonucleotide probe
  misc_binding (1)..(17): Hybridization probe for the specific detection of mutant HIV-1 at codon 155 of the integrase gene.
rtcyatgataargaatt

SEQ ID NO: 19021 - DNA, 15 bp, Artificial Sequence
  Oligonucleotide probe
  misc_binding (1)..(15): Hybridization probe for the specific detection of mutant HIV-1 at codon 155 of the integrase gene.
artcyatgataarga

SEQ ID NO: 19022 - DNA, 15 bp, Artificial Sequence
  Oligonucleotide probe
  misc_binding (1)..(15): Hybridization probe for the specific detection of mutant HIV-1 at codon 155 of the integrase gene.
rtcyatgataargaa

SEQ ID NO: 19023 - DNA, 13 bp, Artificial Sequence
  Oligonucleotide probe
  misc_binding (1)..(13): Hybridization probe for the specific detection of mutant HIV-1 at codon 155 of the integrase gene.
artcyatgataar

SEQ ID NO: 19024 - DNA, 13 bp, Artificial Sequence
  Oligonucleotide probe
  misc_binding (1)..(13): Hybridization probe for the specific detection of mutant HIV-1 at codon 155 of the integrase gene.
rtcyatgataarg

SEQ ID NO: 19025 - DNA, 15 bp, Artificial Sequence
  Oligonucleotide probe
  misc_binding (1)..(15): Hybridization probe for the specific detection of mutant HIV-1 at codon 155 of the integrase gene.
tctatgcayaaagaa

SEQ ID NO: 19026 - DNA, 15 bp, Artificial Sequence
  Oligonucleotide probe
  misc_binding (1)..(15): Hybridization probe for the specific detection of mutant HIV-1 at codon 155 of the integrase gene.
tctatgagyaaagaa

SEQ ID NO: 19027 - DNA, 15 bp, Artificial Sequence
  Oligonucleotide probe
  misc_binding (1)..(15): Hybridization probe for the specific detection of mutant HIV-1 at codon 155 of the integrase gene.
tctatgacyaaagaa

SEQ ID NO: 19028 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (9)..(9): base is a locked nucleic acid
  modified_base (10)..(10): base is a locked nucleic acid
aaaatyatagrcargtma

SEQ ID NO: 19029 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (3)..(3): base is a locked nucleic acid
aaaatyatagrcargtma

SEQ ID NO: 19030 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (4)..(4): base is a locked nucleic acid
aaaatyatagrcargtma

SEQ ID NO: 19031 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (8)..(8): base is a locked nucleic acid
aaaatyatagrcargtma

SEQ ID NO: 19032 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (2)..(2): base is a locked nucleic acid
aaaatyatagrcargtma

SEQ ID NO: 19033 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (15)..(15): base is a locked nucleic acid
aaaatyatagrcargtma

SEQ ID NO: 19034 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (10)..(10): base is a locked nucleic acid
aaaatyatagrcargtma

SEQ ID NO: 19035 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (11)..(11): base is a locked nucleic acid
aaaatyatagrcargtma

SEQ ID NO: 19036 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (14)..(14): base is a locked nucleic acid
aaaatyatagrcargtma

SEQ ID NO: 19037 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (5)..(5): base is a locked nucleic acid
  modified_base (9)..(9): base is a locked nucleic acid
  modified_base (10)..(10): base is a locked nucleic acid
aaaatyatagrcargtma

SEQ ID NO: 19038 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (3)..(3): base is a locked nucleic acid
  modified_base (9)..(9): base is a locked nucleic acid
  modified_base (10)..(10): base is a locked nucleic acid
aaaatyatagrcargtma

SEQ ID NO: 19039 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (6)..(6): base is a locked nucleic acid
  modified_base (9)..(9): base is a locked nucleic acid
  modified_base (10)..(10): base is a locked nucleic acid
aaaatyatagrcargtma

SEQ ID NO: 19040 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (7)..(7): base is a locked nucleic acid
  modified_base (9)..(9): base is a locked nucleic acid
  modified_base (10)..(10): base is a locked nucleic acid
aaaatyatagrcargtma

SEQ ID NO: 19041 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (9)..(9): base is a locked nucleic acid
  modified_base (10)..(10): base is a locked nucleic acid
  modified_base (11)..(11): base is a locked nucleic acid
aaaatyatagrcargtma

SEQ ID NO: 19042 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (9)..(9): base is a locked nucleic acid
  modified_base (10)..(10): base is a locked nucleic acid
  modified_base (13)..(13): base is a locked nucleic acid
aaaatyatagrcargtma

SEQ ID NO: 19043 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (9)..(9): base is a locked nucleic acid
  modified_base (10)..(10): base is a locked nucleic acid
  modified_base (12)..(12): base is a locked nucleic acid
aaaatyatagrcargtma

SEQ ID NO: 19044 - DNA, 18 bp, Artificial Sequence
  Oligonucleotide probe
  misc_binding (1)..(18): Hybridization probe for the specific detection of mutant HIV-1 at codon 163 of the integrase gene.
  modified_base (9)..(9): base is a locked nucleic acid
  modified_base (10)..(10): base is a locked nucleic acid
  modified_base (14)..(14): base is a locked nucleic acid
aaaatyatagrcargtma

SEQ ID NO: 19045 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (8)..(8): base is a locked nucleic acid
  modified_base (9)..(9): base is a locked nucleic acid
aaatyatagrcargtma

SEQ ID NO: 19046 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (2)..(2): base is a locked nucleic acid
aaatyatagrcargtma

SEQ ID NO: 19047 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (3)..(3): base is a locked nucleic acid
aaatyatagrcargtma

SEQ ID NO: 19048 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (7)..(7): base is a locked nucleic acid
aaatyatagrcargtma

SEQ ID NO: 19049 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (1)..(1): base is a locked nucleic acid
aaatyatagrcargtma

SEQ ID NO: 19050 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (14)..(14): base is a locked nucleic acid
aaatyatagrcargtma

SEQ ID NO: 19051 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (9)..(9): base is a locked nucleic acid
aaatyatagrcargtma

SEQ ID NO: 19052 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (10)..(10): base is a locked nucleic acid
aaatyatagrcargtma

SEQ ID NO: 19053 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (13)..(13): base is a locked nucleic acid
aaatyatagrcargtma

SEQ ID NO: 19054 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (4)..(4): base is a locked nucleic acid
  modified_base (8)..(8): base is a locked nucleic acid
  modified_base (9)..(9): base is a locked nucleic acid
aaatyatagrcargtma

SEQ ID NO: 19055 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (2)..(2): base is a locked nucleic acid
  modified_base (8)..(8): base is a locked nucleic acid
  modified_base (9)..(9): base is a locked nucleic acid
aaatyatagrcargtma

SEQ ID NO: 19056 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (5)..(5): base is a locked nucleic acid
  modified_base (8)..(8): base is a locked nucleic acid
  modified_base (9)..(9): base is a locked nucleic acid
aaatyatagrcargtma

SEQ ID NO: 19057 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (6)..(6): base is a locked nucleic acid
  modified_base (8)..(8): base is a locked nucleic acid
  modified_base (9)..(9): base is a locked nucleic acid
aaatyatagrcargtma

SEQ ID NO: 19058 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (10)..(10): base is a locked nucleic acid
aaatyatagrcargtma

SEQ ID NO: 19059 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (12)..(12): base is a locked nucleic acid
aaatyatagrcargtma

SEQ ID NO: 19060 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (11)..(11): base is a locked nucleic acid
aaatyatagrcargtma

SEQ ID NO: 19061 - DNA, 17 bp, Artificial Sequence
  Oligonucleotide probe
  misc_binding (1)..(17): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (13)..(13): base is a locked nucleic acid
aaatyatagrcargtma

SEQ ID NO: 19062 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (8)..(8): base is a locked nucleic acid
  modified_base (9)..(9): base is a locked nucleic acid
aaatyatagrcargt

SEQ ID NO: 19063 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (2)..(2): base is a locked nucleic acid
aaatyatagrcargt

SEQ ID NO: 19064 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (3)..(3): base is a locked nucleic acid
aaatyatagrcargt

SEQ ID NO: 19065 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (7)..(7): base is a locked nucleic acid
aaatyatagrcargt

SEQ ID NO: 19066 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (1)..(1): base is a locked nucleic acid
aaatyatagrcargt

SEQ ID NO: 19067 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (14)..(14): base is a locked nucleic acid
aaatyatagrcargt

SEQ ID NO: 19068 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (9)..(9): base is a locked nucleic acid
aaatyatagrcargt

SEQ ID NO: 19069 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (10)..(10): base is a locked nucleic acid
aaatyatagrcargt

SEQ ID NO: 19070 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (13)..(13): base is a locked nucleic acid
aaatyatagrcargt

SEQ ID NO: 19071 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (4)..(4): base is a locked nucleic acid
  modified_base (8)..(8): base is a locked nucleic acid
  modified_base (9)..(9): base is a locked nucleic acid
aaatyatagrcargt

SEQ ID NO: 19072 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (2)..(2): base is a locked nucleic acid
  modified_base (8)..(8): base is a locked nucleic acid
  modified_base (9)..(9): base is a locked nucleic acid
aaatyatagrcargt

SEQ ID NO: 19073 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (5)..(5): base is a locked nucleic acid
  modified_base (8)..(8): base is a locked nucleic acid
  modified_base (9)..(9): base is a locked nucleic acid
aaatyatagrcargt

SEQ ID NO: 19074 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (6)..(6): base is a locked nucleic acid
  modified_base (8)..(8): base is a locked nucleic acid
  modified_base (9)..(9): base is a locked nucleic acid
aaatyatagrcargt

SEQ ID NO: 19075 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (10)..(10): base is a locked nucleic acid
aaatyatagrcargt

SEQ ID NO: 19076 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (12)..(12): base is a locked nucleic acid
aaatyatagrcargt

SEQ ID NO: 19077 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (11)..(11): base is a locked nucleic acid
aaatyatagrcargt

SEQ ID NO: 19078 - DNA, 15 bp, Artificial Sequence
  Oligonucleotide probe
  misc_binding (1)..(15): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (13)..(13): base is a locked nucleic acid
aaatyatagrcargt

SEQ ID NO: 19079 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (8)..(8): base is a locked nucleic acid
  modified_base (9)..(9): base is a locked nucleic acid
aaatyatagrcar

SEQ ID NO: 19080 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (2)..(2): base is a locked nucleic acid
aaatyatagrcar

SEQ ID NO: 19081 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (3)..(3): base is a locked nucleic acid
aaatyatagrcar

SEQ ID NO: 19082 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (7)..(7): base is a locked nucleic acid
aaatyatagrcar

SEQ ID NO: 19083 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (1)..(1): base is a locked nucleic acid
aaatyatagrcar

SEQ ID NO: 19084 - DNA, 13 bp, Artificial Sequence
  Oligonucleotide probe
  misc_binding (1)..(13): Hybridization probe for the specific detection of mutant HIV-1 at codon 163 of the integrase gene.
aaatyatagrcar

SEQ ID NO: 19085 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (9)..(9): base is a locked nucleic acid
aaatyatagrcar

SEQ ID NO: 19086 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (10)..(10): base is a locked nucleic acid
aaatyatagrcar

SEQ ID NO: 19087 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (13)..(13): base is a locked nucleic acid
aaatyatagrcar

SEQ ID NO: 19088 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (4)..(4): base is a locked nucleic acid
  modified_base (8)..(8): base is a locked nucleic acid
  modified_base (9)..(9): base is a locked nucleic acid
aaatyatagrcar

SEQ ID NO: 19089 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (2)..(2): base is a locked nucleic acid
  modified_base (8)..(8): base is a locked nucleic acid
  modified_base (9)..(9): base is a locked nucleic acid
aaatyatagrcar

SEQ ID NO: 19090 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (5)..(5): base is a locked nucleic acid
  modified_base (8)..(8): base is a locked nucleic acid
  modified_base (9)..(9): base is a locked nucleic acid
aaatyatagrcar

SEQ ID NO: 19091 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (6)..(6): base is a locked nucleic acid
  modified_base (8)..(8): base is a locked nucleic acid
  modified_base (9)..(9): base is a locked nucleic acid
aaatyatagrcar

SEQ ID NO: 19092 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (10)..(10): base is a locked nucleic acid
aaatyatagrcar

SEQ ID NO: 19093 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (12)..(12): base is a locked nucleic acid
aaatyatagrcar

SEQ ID NO: 19094 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (11)..(11): base is a locked nucleic acid
aaatyatagrcar

SEQ ID NO: 19095 - DNA, 13 bp, Artificial Sequence
  Oligonucleotide probe
  misc_binding (1)..(13): Hybridization probe for the specific detection of mutant HIV-1 at codon 163 of the integrase gene.
  modified_base (8)..(8): base is a locked nucleic acid
  modified_base (9)..(9): base is a locked nucleic acid
  modified_base (13)..(13): base is a locked nucleic acid
aaatyatagrcar

SEQ ID NO: 19096 - DNA, 18 bp, Artificial Sequence
  Oligonucleotide probe
  misc_binding (1)..(18): Hybridization probe for the specific detection of mutant HIV-1 at codon 163 of the integrase gene.
aaaatyatagrcargtma

SEQ ID NO: 19097 - DNA, 17 bp, Artificial Sequence
  Oligonucleotide probe
  misc_binding (1)..(17): Hybridization probe for the specific detection of mutant HIV-1 at codon 163 of the integrase gene.
aaatyatagrcargtma

SEQ ID NO: 19098 - DNA, 15 bp, Artificial Sequence
  Oligonucleotide probe
  misc_binding (1)..(15): Hybridization probe for the specific detection of mutant HIV-1 at codon 163 of the integrase gene.
aaatyatagrcargt

SEQ ID NO: 19099 - DNA, 13 bp, Artificial Sequence
  Oligonucleotide probe
  misc_binding (1)..(13): Hybridization probe for the specific detection of mutant HIV-1 at codon 163 of the integrase gene.
aaatyatagrcar

SEQ ID NO: 19100 - DNA, 15 bp, Artificial Sequence
  Oligonucleotide probe
  misc_binding (1)..(15): Hybridization probe for the specific detection of mutant HIV-1 at codon 163 of the integrase gene.
attatamgrcaggta

SEQ ID NO: 19101 - DNA, 15 bp, Artificial Sequence
  Oligonucleotide probe
  misc_binding (1)..(15): Hybridization probe for the specific detection of mutant HIV-1 at codon 163 of the integrase gene.
attataaarcaggta

SEQ ID NO: 19102 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (9)..(9): base is a locked nucleic acid
  modified_base (10)..(10): base is a locked nucleic acid
tacagrgacgcagagayc

SEQ ID NO: 19103 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (9)..(9): base is a locked nucleic acid
tacagrgacgcagagayc

SEQ ID NO: 19104 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (7)..(7): base is a locked nucleic acid
tacagrgacgcagagayc

SEQ ID NO: 19105 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (3)..(3): base is a locked nucleic acid
tacagrgacgcagagayc

SEQ ID NO: 19106 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (2)..(2): base is a locked nucleic acid
tacagrgacgcagagayc

SEQ ID NO: 19107 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (10)..(10): base is a locked nucleic acid
tacagrgacgcagagayc

SEQ ID NO: 19108 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (11)..(11): base is a locked nucleic acid
tacagrgacgcagagayc

SEQ ID NO: 19109 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (12)..(12): base is a locked nucleic acid
tacagrgacgcagagayc

SEQ ID NO: 19110 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (17)..(17): base is a locked nucleic acid
tacagrgacgcagagayc

SEQ ID NO: 19111 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (8)..(8): base is a locked nucleic acid
  modified_base (9)..(9): base is a locked nucleic acid
  modified_base (10)..(10): base is a locked nucleic acid
tacagrgacgcagagayc

SEQ ID NO: 19112 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (7)..(7): base is a locked nucleic acid
  modified_base (9)..(9): base is a locked nucleic acid
  modified_base (10)..(10): base is a locked nucleic acid
tacagrgacgcagagayc

SEQ ID NO: 19113 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (4)..(4): base is a locked nucleic acid
  modified_base (9)..(9): base is a locked nucleic acid
  modified_base (10)..(10): base is a locked nucleic acid
tacagrgacgcagagayc

SEQ ID NO: 19114 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (6)..(6): base is a locked nucleic acid
  modified_base (9)..(9): base is a locked nucleic acid
  modified_base (10)..(10): base is a locked nucleic acid
tacagrgacgcagagayc

SEQ ID NO: 19115 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (9)..(9): base is a locked nucleic acid
  modified_base (10)..(10): base is a locked nucleic acid
  modified_base (12)..(12): base is a locked nucleic acid
tacagrgacgcagagayc

SEQ ID NO: 19116 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (9)..(9): base is a locked nucleic acid
  modified_base (10)..(10): base is a locked nucleic acid
  modified_base (18)..(18): base is a locked nucleic acid
tacagrgacgcagagayc

SEQ ID NO: 19117 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (9)..(9): base is a locked nucleic acid
  modified_base (10)..(10): base is a locked nucleic acid
  modified_base (11)..(11): base is a locked nucleic acid
tacagrgacgcagagayc

SEQ ID NO: 19118 - DNA, 18 bp, Artificial Sequence
  Oligonucleotide probe
  misc_binding (1)..(18): Hybridization probe for the specific detection of mutant HIV-1 at codon 230 of the integrase gene.
  modified_base (9)..(9): base is a locked nucleic acid
  modified_base (10)..(10): base is a locked nucleic acid
  modified_base (15)..(15): base is a locked nucleic acid
tacagrgacgcagagayc

SEQ ID NO: 19119 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (8)..(8): base is a locked nucleic acid
  modified_base (9)..(9): base is a locked nucleic acid
acagrgacgcagagayc

SEQ ID NO: 19120 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (8)..(8): base is a locked nucleic acid
acagrgacgcagagayc

SEQ ID NO: 19121 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (6)..(6): base is a locked nucleic acid
acagrgacgcagagayc

SEQ ID NO: 19122 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (2)..(2): base is a locked nucleic acid
acagrgacgcagagayc

SEQ ID NO: 19123 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (1)..(1): base is a locked nucleic acid
acagrgacgcagagayc

SEQ ID NO: 19124 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (9)..(9): base is a locked nucleic acid
acagrgacgcagagayc

SEQ ID NO: 19125 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (10)..(10): base is a locked nucleic acid
acagrgacgcagagayc

SEQ ID NO: 19126 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (11)..(11): base is a locked nucleic acid
acagrgacgcagagayc

SEQ ID NO: 19127 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (16)..(16): base is a locked nucleic acid
acagrgacgcagagayc

SEQ ID NO: 19128 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (7)..(7): base is a locked nucleic acid
  modified_base (8)..(8): base is a locked nucleic acid
  modified_base (9)..(9): base is a locked nucleic acid
acagrgacgcagagayc

SEQ ID NO: 19129 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (6)..(6): base is a locked nucleic acid
  modified_base (8)..(8): base is a locked nucleic acid
  modified_base (9)..(9): base is a locked nucleic acid
acagrgacgcagagayc

SEQ ID NO: 19130 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (3)..(3): base is a locked nucleic acid
  modified_base (8)..(8): base is a locked nucleic acid
  modified_base (9)..(9): base is a locked nucleic acid
acagrgacgcagagayc

SEQ ID NO: 19131 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (5)..(5): base is a locked nucleic acid
  modified_base (8)..(8): base is a locked nucleic acid
  modified_base (9)..(9): base is a locked nucleic acid
acagrgacgcagagayc

SEQ ID NO: 19132 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (8)..(8): base is a locked nucleic acid
  modified_base (9)..(9): base is a locked nucleic acid
  modified_base (11)..(11): base is a locked nucleic acid
acagrgacgcagagayc

SEQ ID NO: 19133 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (8)..(8): base is a locked nucleic acid
  modified_base (9)..(9): base is a locked nucleic acid
  modified_base (17)..(17): base is a locked nucleic acid
acagrgacgcagagayc

SEQ ID NO: 19134 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (8)..(8): base is a locked nucleic acid
  modified_base (9)..(9): base is a locked nucleic acid
  modified_base (10)..(10): base is a locked nucleic acid
acagrgacgcagagayc

SEQ ID NO: 19135 - DNA, 17 bp, Artificial Sequence
  Oligonucleotide probe
  misc_binding (1)..(17): Hybridization probe for the specific detection of mutant HIV-1 at codon 230 of the integrase gene.
  modified_base (8)..(8): base is a locked nucleic acid
  modified_base (9)..(9): base is a locked nucleic acid
  modified_base (14)..(14): base is a locked nucleic acid
acagrgacgcagagayc

SEQ ID NO: 19136 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (8)..(8): base is a locked nucleic acid
  modified_base (9)..(9): base is a locked nucleic acid
acagrgacgcagaga

SEQ ID NO: 19137 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (8)..(8): base is a locked nucleic acid
acagrgacgcagaga

SEQ ID NO: 19138 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (6)..(6): base is a locked nucleic acid
acagrgacgcagaga

SEQ ID NO: 19139 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (2)..(2): base is a locked nucleic acid
acagrgacgcagaga

SEQ ID NO: 19140 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (1)..(1): base is a locked nucleic acid
acagrgacgcagaga

SEQ ID NO: 19141 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (9)..(9): base is a locked nucleic acid
acagrgacgcagaga

SEQ ID NO: 19142 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (10)..(10): base is a locked nucleic acid
acagrgacgcagaga

SEQ ID NO: 19143 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (11)..(11): base is a locked nucleic acid
acagrgacgcagaga

SEQ ID NO: 19144 - DNA, 15 bp, Artificial Sequence
  Oligonucleotide probe
  misc_binding (1)..(15): Hybridization probe for the specific detection of mutant HIV-1 at codon 230 of the integrase gene.
acagrgacgcagaga

SEQ ID NO: 19145 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (7)..(7): base is a locked nucleic acid
  modified_base (8)..(8): base is a locked nucleic acid
  modified_base (9)..(9): base is a locked nucleic acid
acagrgacgcagaga

SEQ ID NO: 19146 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (6)..(6): base is a locked nucleic acid
  modified_base (8)..(8): base is a locked nucleic acid
  modified_base (9)..(9): base is a locked nucleic acid
acagrgacgcagaga

SEQ ID NO: 19147 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (3)..(3): base is a locked nucleic acid
  modified_base (8)..(8): base is a locked nucleic acid
  modified_base (9)..(9): base is a locked nucleic acid
acagrgacgcagaga

SEQ ID NO: 19148 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (5)..(5): base is a locked nucleic acid
  modified_base (8)..(8): base is a locked nucleic acid
  modified_base (9)..(9): base is a locked nucleic acid
acagrgacgcagaga

SEQ ID NO: 19149 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (8)..(8): base is a locked nucleic acid
  modified_base (9)..(9): base is a locked nucleic acid
  modified_base (11)..(11): base is a locked nucleic acid
acagrgacgcagaga

SEQ ID NO: 19150 - DNA, 16 bp, Artificial Sequence
  Oligonucleotide probe
  misc_binding (1)..(16): Hybridization probe for the specific detection of mutant HIV-1 at codon 230 of the integrase gene.
  modified_base (8)..(8): base is a locked nucleic acid
  modified_base (9)..(9): base is a locked nucleic acid
acagrgacgcagagay

SEQ ID NO: 19151 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (8)..(8): base is a locked nucleic acid
  modified_base (9)..(9): base is a locked nucleic acid
  modified_base (10)..(10): base is a locked nucleic acid
acagrgacgcagaga

SEQ ID NO: 19152 - DNA, 15 bp, Artificial Sequence
  Oligonucleotide probe
  misc_binding (1)..(15): Hybridization probe for the specific detection of mutant HIV-1 at codon 230 of the integrase gene.
  modified_base (8)..(8): base is a locked nucleic acid
  modified_base (9)..(9): base is a locked nucleic acid
  modified_base (14)..(14): base is a locked nucleic acid
acagrgacgcagaga

SEQ ID NO: 19153 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (8)..(8): base is a locked nucleic acid
  modified_base (9)..(9): base is a locked nucleic acid
acagrgacgcaga

SEQ ID NO: 19154 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (8)..(8): base is a locked nucleic acid
acagrgacgcaga

SEQ ID NO: 19155 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (6)..(6): base is a locked nucleic acid
acagrgacgcaga

SEQ ID NO: 19156 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (2)..(2): base is a locked nucleic acid
acagrgacgcaga

SEQ ID NO: 19157 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (1)..(1): base is a locked nucleic acid
acagrgacgcaga

SEQ ID NO: 19158 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (9)..(9): base is a locked nucleic acid
acagrgacgcaga

SEQ ID NO: 19159 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (10)..(10): base is a locked nucleic acid
acagrgacgcaga

SEQ ID NO: 19160 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (11)..(11): base is a locked nucleic acid
acagrgacgcaga

SEQ ID NO: 19161 - DNA, 14 bp, Artificial Sequence
  Oligonucleotide probe
  misc_binding (1)..(14): Hybridization probe for the specific detection of mutant HIV-1 at codon 230 of the integrase gene.
acagrgacgcagag

SEQ ID NO: 19162 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (7)..(7): base is a locked nucleic acid
  modified_base (8)..(8): base is a locked nucleic acid
  modified_base (9)..(9): base is a locked nucleic acid
acagrgacgcaga

SEQ ID NO: 19163 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (6)..(6): base is a locked nucleic acid
  modified_base (8)..(8): base is a locked nucleic acid
  modified_base (9)..(9): base is a locked nucleic acid
acagrgacgcaga

SEQ ID NO: 19164 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (3)..(3): base is a locked nucleic acid
  modified_base (8)..(8): base is a locked nucleic acid
  modified_base (9)..(9): base is a locked nucleic acid
acagrgacgcaga

SEQ ID NO: 19165 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (5)..(5): base is a locked nucleic acid
  modified_base (8)..(8): base is a locked nucleic acid
  modified_base (9)..(9): base is a locked nucleic acid
acagrgacgcaga

SEQ ID NO: 19166 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (8)..(8): base is a locked nucleic acid
  modified_base (9)..(9): base is a locked nucleic acid
  modified_base (11)..(11): base is a locked nucleic acid
acagrgacgcaga

SEQ ID NO: 19167 - DNA, 14 bp, Artificial Sequence
  Oligonucleotide probe
  misc_binding (1)..(14): Hybridization probe for the specific detection of mutant HIV-1 at codon 230 of the integrase gene.
  modified_base (8)..(8): base is a locked nucleic acid
  modified_base (9)..(9): base is a locked nucleic acid
acagrgacgcagag

SEQ ID NO: 19168 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (8)..(8): base is a locked nucleic acid
  modified_base (9)..(9): base is a locked nucleic acid
  modified_base (10)..(10): base is a locked nucleic acid
acagrgacgcaga

SEQ ID NO: 19169 - DNA, 13 bp, Artificial Sequence
  Oligonucleotide probe
  misc_binding (1)..(13): Hybridization probe for the specific detection of mutant HIV-1 at codon 230 of the integrase gene.
  modified_base (8)..(8): base is a locked nucleic acid
  modified_base (9)..(9): base is a locked nucleic acid
acagrgacgcaga

SEQ ID NO: 19170 - DNA, 18 bp, Artificial Sequence
  Oligonucleotide probe
  misc_binding (1)..(18): Hybridization probe for the specific detection of mutant HIV-1 at codon 230 of the integrase gene.
tacagrgacgcagagayc

SEQ ID NO: 19171 - DNA, 17 bp, Artificial Sequence
  Oligonucleotide probe
  misc_binding (1)..(17): Hybridization probe for the specific detection of mutant HIV-1 at codon 230 of the integrase gene.
acagrgacgcagagayc

SEQ ID NO: 19172 - DNA, 15 bp, Artificial Sequence
  Oligonucleotide probe
  misc_binding (1)..(15): Hybridization probe for the specific detection of mutant HIV-1 at codon 230 of the integrase gene.
acagrgacgcagaga

SEQ ID NO: 19173 - DNA, 16 bp, Artificial Sequence
  Oligonucleotide probe
  misc_binding (1)..(16): Hybridization probe for the specific detection of mutant HIV-1 at codon 230 of the integrase gene.
acagrgacgcagagay

SEQ ID NO: 19174 - DNA, 13 bp, Artificial Sequence
  Oligonucleotide probe
  misc_binding (1)..(13): Hybridization probe for the specific detection of mutant HIV-1 at codon 230 of the integrase gene.
acagrgacgcaga

SEQ ID NO: 19175 - DNA, 15 bp, Artificial Sequence
  Oligonucleotide probe
  misc_binding (1)..(15): Hybridization probe for the specific detection of mutant HIV-1 at codon 230 of the integrase gene.
agggaccgcagagac

SEQ ID NO: 19176 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (9)..(9): base is a locked nucleic acid
  modified_base (10)..(10): base is a locked nucleic acid
trccaagraraaagyaaa

SEQ ID NO: 19177 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (8)..(8): base is a locked nucleic acid
trccaagraraaagyaaa

SEQ ID NO: 19178 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (7)..(7): base is a locked nucleic acid
trccaagraraaagyaaa

SEQ ID NO: 19179 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (3)..(3): base is a locked nucleic acid
trccaagraraaagyaaa

SEQ ID NO: 19180 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (4)..(4): base is a locked nucleic acid
trccaagraraaagyaaa

SEQ ID NO: 19181 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (14)..(14): base is a locked nucleic acid
trccaagraraaagyaaa

SEQ ID NO: 19182 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (16)..(16): base is a locked nucleic acid
trccaagraraaagyaaa

SEQ ID NO: 19183 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (13)..(13): base is a locked nucleic acid
trccaagraraaagyaaa

SEQ ID NO: 19184 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (11)..(11): base is a locked nucleic acid
trccaagraraaagyaaa

SEQ ID NO: 19185 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (3)..(3): base is a locked nucleic acid
  modified_base (9)..(9): base is a locked nucleic acid
  modified_base (10)..(10): base is a locked nucleic acid
trccaagraraaagyaaa

SEQ ID NO: 19186 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (4)..(4): base is a locked nucleic acid
  modified_base (9)..(9): base is a locked nucleic acid
  modified_base (10)..(10): base is a locked nucleic acid
trccaagraraaagyaaa

SEQ ID NO: 19187 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (7)..(7): base is a locked nucleic acid
  modified_base (9)..(9): base is a locked nucleic acid
  modified_base (10)..(10): base is a locked nucleic acid
trccaagraraaagyaaa

SEQ ID NO: 19188 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (10)..(10): base is a locked nucleic acid
trccaagraraaagyaaa

SEQ ID NO: 19189 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (9)..(9): base is a locked nucleic acid
  modified_base (10)..(10): base is a locked nucleic acid
  modified_base (15)..(15): base is a locked nucleic acid
trccaagraraaagyaaa

SEQ ID NO: 19190 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (9)..(9): base is a locked nucleic acid
  modified_base (10)..(10): base is a locked nucleic acid
  modified_base (13)..(13): base is a locked nucleic acid
trccaagraraaagyaaa

SEQ ID NO: 19191 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (9)..(9): base is a locked nucleic acid
  modified_base (10)..(10): base is a locked nucleic acid
  modified_base (14)..(14): base is a locked nucleic acid
trccaagraraaagyaaa

SEQ ID NO: 19192 - DNA, 18 bp, Artificial Sequence
  Oligonucleotide probe
  misc_binding (1)..(18): Hybridization probe for the specific detection of mutant HIV-1 at codon 263 of the integrase gene.
  modified_base (9)..(9): base is a locked nucleic acid
  modified_base (10)..(10): base is a locked nucleic acid
  modified_base (11)..(11): base is a locked nucleic acid
trccaagraraaagyaaa

SEQ ID NO: 19193 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (8)..(8): base is a locked nucleic acid
  modified_base (9)..(9): base is a locked nucleic acid
rccaagraraaagyaaa

SEQ ID NO: 19194 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (7)..(7): base is a locked nucleic acid
rccaagraraaagyaaa

SEQ ID NO: 19195 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (6)..(6): base is a locked nucleic acid
rccaagraraaagyaaa

SEQ ID NO: 19196 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (2)..(2): base is a locked nucleic acid
rccaagraraaagyaaa

SEQ ID NO: 19197 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (3)..(3): base is a locked nucleic acid
rccaagraraaagyaaa

SEQ ID NO: 19198 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (13)..(13): base is a locked nucleic acid
rccaagraraaagyaaa

SEQ ID NO: 19199 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (15)..(15): base is a locked nucleic acid
rccaagraraaagyaaa

SEQ ID NO: 19200 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (12)..(12): base is a locked nucleic acid
rccaagraraaagyaaa

SEQ ID NO: 19201 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (10)..(10): base is a locked nucleic acid
rccaagraraaagyaaa

SEQ ID NO: 19202 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (2)..(2): base is a locked nucleic acid
  modified_base (8)..(8): base is a locked nucleic acid
  modified_base (9)..(9): base is a locked nucleic acid
rccaagraraaagyaaa

SEQ ID NO: 19203 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (3)..(3): base is a locked nucleic acid
  modified_base (8)..(8): base is a locked nucleic acid
  modified_base (9)..(9): base is a locked nucleic acid
rccaagraraaagyaaa

SEQ ID NO: 19204 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (6)..(6): base is a locked nucleic acid
  modified_base (8)..(8): base is a locked nucleic acid
  modified_base (9)..(9): base is a locked nucleic acid
rccaagraraaagyaaa

SEQ ID NO: 19205 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (7)..(7): base is a locked nucleic acid
  modified_base (8)..(8): base is a locked nucleic acid
  modified_base (9)..(9): base is a locked nucleic acid
rccaagraraaagyaaa

SEQ ID NO: 19206 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (14)..(14): base is a locked nucleic acid
rccaagraraaagyaaa

SEQ ID NO: 19207 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (12)..(12): base is a locked nucleic acid
rccaagraraaagyaaa

SEQ ID NO: 19208 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (13)..(13): base is a locked nucleic acid
rccaagraraaagyaaa

SEQ ID NO: 19209 - DNA, 17 bp, Artificial Sequence
  Oligonucleotide probe
  misc_binding (1)..(17): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (10)..(10): base is a locked nucleic acid
rccaagraraaagyaaa

SEQ ID NO: 19210 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (8)..(8): base is a locked nucleic acid
  modified_base (9)..(9): base is a locked nucleic acid
rccaagraraaagya

SEQ ID NO: 19211 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (7)..(7): base is a locked nucleic acid
rccaagraraaagya

SEQ ID NO: 19212 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (6)..(6): base is a locked nucleic acid
rccaagraraaagya

SEQ ID NO: 19213 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (2)..(2): base is a locked nucleic acid
rccaagraraaagya

SEQ ID NO: 19214 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (3)..(3): base is a locked nucleic acid
rccaagraraaagya

SEQ ID NO: 19215 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (13)..(13): base is a locked nucleic acid
rccaagraraaagya

SEQ ID NO: 19216 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (15)..(15): base is a locked nucleic acid
rccaagraraaagya

SEQ ID NO: 19217 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (12)..(12): base is a locked nucleic acid
rccaagraraaagya

SEQ ID NO: 19218 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (10)..(10): base is a locked nucleic acid
rccaagraraaagya

SEQ ID NO: 19219 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (2)..(2): base is a locked nucleic acid
  modified_base (8)..(8): base is a locked nucleic acid
  modified_base (9)..(9): base is a locked nucleic acid
rccaagraraaagya

SEQ ID NO: 19220 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (3)..(3): base is a locked nucleic acid
  modified_base (8)..(8): base is a locked nucleic acid
  modified_base (9)..(9): base is a locked nucleic acid
rccaagraraaagya

SEQ ID NO: 19221 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (6)..(6): base is a locked nucleic acid
  modified_base (8)..(8): base is a locked nucleic acid
  modified_base (9)..(9): base is a locked nucleic acid
rccaagraraaagya

SEQ ID NO: 19222 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (7)..(7): base is a locked nucleic acid
  modified_base (8)..(8): base is a locked nucleic acid
  modified_base (9)..(9): base is a locked nucleic acid
rccaagraraaagya

SEQ ID NO: 19223 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (14)..(14): base is a locked nucleic acid
rccaagraraaagya

SEQ ID NO: 19224 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (12)..(12): base is a locked nucleic acid
rccaagraraaagya

SEQ ID NO: 19225 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (13)..(13): base is a locked nucleic acid
rccaagraraaagya

SEQ ID NO: 19226 - DNA, 15 bp, Artificial Sequence
  Oligonucleotide probe
  misc_binding (1)..(15): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (10)..(10): base is a locked nucleic acid
rccaagraraaagya

SEQ ID NO: 19227 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (8)..(8): base is a locked nucleic acid
  modified_base (9)..(9): base is a locked nucleic acid
rccaagraraaag

SEQ ID NO: 19228 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (7)..(7): base is a locked nucleic acid
rccaagraraaag

SEQ ID NO: 19229 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (6)..(6): base is a locked nucleic acid
rccaagraraaag

SEQ ID NO: 19230 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (2)..(2): base is a locked nucleic acid
rccaagraraaag

SEQ ID NO: 19231 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (3)..(3): base is a locked nucleic acid
rccaagraraaag

SEQ ID NO: 19232 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (13)..(13): base is a locked nucleic acid
rccaagraraaag

SEQ ID NO: 19233 - DNA, 14 bp, Artificial Sequence
  Oligonucleotide probe
  misc_binding (1)..(14): Hybridization probe for the specific detection of mutant HIV-1 at codon 263 of the integrase gene.
rccaagraraaagy

SEQ ID NO: 19234 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (12)..(12): base is a locked nucleic acid
rccaagraraaag

SEQ ID NO: 19235 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (10)..(10): base is a locked nucleic acid
rccaagraraaag

SEQ ID NO: 19236 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (2)..(2): base is a locked nucleic acid
  modified_base (8)..(8): base is a locked nucleic acid
  modified_base (9)..(9): base is a locked nucleic acid
rccaagraraaag

SEQ ID NO: 19237 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (3)..(3): base is a locked nucleic acid
  modified_base (8)..(8): base is a locked nucleic acid
  modified_base (9)..(9): base is a locked nucleic acid
rccaagraraaag

SEQ ID NO: 19238 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (6)..(6): base is a locked nucleic acid
  modified_base (8)..(8): base is a locked nucleic acid
  modified_base (9)..(9): base is a locked nucleic acid
rccaagraraaag

SEQ ID NO: 19239 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (7)..(7): base is a locked nucleic acid
  modified_base (8)..(8): base is a locked nucleic acid
  modified_base (9)..(9): base is a locked nucleic acid
rccaagraraaag

SEQ ID NO: 19240 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (8)..(8): base is a locked nucleic acid
  modified_base (9)..(9): base is a locked nucleic acid
rccaagraraaag

SEQ ID NO: 19241 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (12)..(12): base is a locked nucleic acid
rccaagraraaag

SEQ ID NO: 19242 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (13)..(13): base is a locked nucleic acid
rccaagraraaag

SEQ ID NO: 19243 - DNA, 13 bp, Artificial Sequence
  Oligonucleotide probe
  misc_binding (1)..(13): Hybridization probe for the specific detection of mutant HIV-1 at codon 263 of the integrase gene.
  modified_base (8)..(8): base is a locked nucleic acid
  modified_base (9)..(9): base is a locked nucleic acid
  modified_base (10)..(10): base is a locked nucleic acid
rccaagraraaag

SEQ ID NO: 19244 - DNA, 18 bp, Artificial Sequence
  Oligonucleotide probe
  misc_binding (1)..(18): Hybridization probe for the specific detection of mutant HIV-1 at codon 263 of the integrase gene.
trccaagraraaagyaaa

SEQ ID NO: 19245 - DNA, 17 bp, Artificial Sequence
  Oligonucleotide probe
  misc_binding (1)..(17): Hybridization probe for the specific detection of mutant HIV-1 at codon 263 of the integrase gene.
rccaagraraaagyaaa

SEQ ID NO: 19246 - DNA, 15 bp, Artificial Sequence
  Oligonucleotide probe
  misc_binding (1)..(15): Hybridization probe for the specific detection of mutant HIV-1 at codon 263 of the integrase gene.
rccaagraraaagya

SEQ ID NO: 19247 - DNA, 13 bp, Artificial Sequence
  Oligonucleotide probe
  misc_binding (1)..(13): Hybridization probe for the specific detection of mutant HIV-1 at codon 263 of the integrase gene.
rccaagraraaag

SEQ ID NO: 19248 - DNA, 15 bp, Artificial Sequence
  Oligonucleotide probe
  misc_binding (1)..(15): Hybridization probe for the specific detection of mutant HIV-1 at codon 263 of the integrase gene.
ccaagaaaraaagca

SEQ ID NO: 19249 - DNA, 30 bp, Artificial Sequence
  Pan degenerate oligonucleotide primer
  primer_bind (1)..(30): Pan degenerate sense primer that amplifies a region of the HIV-1 genome that incorporates codon 103 of the reverse transcriptase gene.
carytaggrataccdcaycchgcrggdytr

SEQ ID NO: 19250 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
aaaagaaaaaatcag

SEQ ID NO: 19251 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
aaaagaaaaaatcag

SEQ ID NO: 19252 - protein, 6 aa, Newcastle disease virus
  site (1)..(6): Protease cleavage site from codons 112 to 117 in the precursor F0 glycoprotein of velogenic and mesogenic strains of Newcastle disease virus.
RRKKRF

SEQ ID NO: 19253 - DNA, 16 bp, Artificial Sequence
  Oligonucleotide probe
  misc_binding (1)..(16): Hybridization probe for the specific detection of pathogenic Newcastle disease virus at the nucleotide coding sequence for the protease cleavage site from codons 112 to 117 in the precursor F0 glycoprotein.
aaacgcttyataggtg

SEQ ID NO: 19254 - DNA, 14 bp, Artificial Sequence
  Oligonucleotide probe
  misc_binding (1)..(14): Hybridization probe for the specific detection of non-pathogenic Newcastle disease virus at the nucleotide coding sequence for the protease cleavage site from codons 112 to 117 in the precursor F0 glycoprotein.
  misc_feature (9)..(9): n is a, c, g, or t
gggcgcctnatagg

SEQ ID NO: 19255 - DNA, 14 bp, Artificial Sequence
  Oligonucleotide probe
  misc_binding (1)..(14): Hybridization probe for the specific detection of non-pathogenic Newcastle disease virus at the nucleotide coding sequence for the protease cleavage site from codons 112 to 117 in the precursor F0 glycoprotein.
gggcgcttratagg

SEQ ID NO: 19256 - DNA, 36 bp, Artificial Sequence
  Pan degenerate oligonucleotide primer
  primer_bind (1)..(36): Pan degenerate sense primer that amplifies a region of the HIV-1 genome that incorporates codon 103 of the reverse transcriptase gene.
  misc_feature (32)..(36): Adaptor region of the pan degenerate sense primer that adapts the probe-binding site upstream of codon 103 to correspond to the nucleotides in an oligonucleotide probe upstream of the discriminating single nucleotide polymorphism.
carytaggrataccdcaycchgcrggdytraaaaag

SEQ ID NO: 19257 - DNA, 29 bp, Artificial Sequence
  Pan degenerate oligonucleotide primer
  primer_bind (1)..(29): Pan degenerate anti-sense primer that amplifies a region of the HIV-1 genome that incorporates codon 103 of the reverse transcriptase gene.
  misc_feature (1)..(6): Adaptor region of the pan degenerate anti-sense primer that adapts the probe-binding site downstream of codon 103 to correspond to the nucleotides in an oligonucleotide probe downstream of the discriminating single nucleotide polymorphism.
aaatcagtracagtrytrgatgtrggdga

SEQ ID NO: 19258 - DNA, 46 bp, Artificial Sequence
  Pan degenerate oligonucleotide primer
  primer_bind (1)..(46): Pan degenerate sense primer that amplifies a region of velogenic and mesogenic strains of the Newcastle disease virus genome that incorporates codons 112 to 117 of the fusion gene.
  misc_feature (25)..(25): n is a, c, g, or t
  misc_feature (41)..(46): Adaptor region of the pan degenerate sense primer that adapts the probe-binding site upstream of codons 112 to 117 to correspond to the nucleotides in an oligonucleotide probe upstream of the discriminating single nucleotide polymorphism.
gathcaagrrtcygyrwcyacrtcnrgrggrrrgagrcrgaaacgc

SEQ ID NO: 19259 - DNA, 50 bp, Artificial Sequence
  Pan degenerate oligonucleotide primer
  primer_bind (1)..(50): Pan degenerate anti-sense primer that amplifies a region of velogenic and mesogenic strains of the Newcastle disease virus genome that incorporates codons 112 to 117 of the fusion gene.
  misc_feature (1)..(6): Adaptor region of the pan degenerate anti-sense primer that adapts the probe-binding site downstream of codons 112 to 117 to correspond to the nucleotides in an oligonucleotide probe downstream of the discriminating single nucleotide polymorphism.
ataggtgcyrttathggyagtrtrgctctyggrgtygcracdkcdgcaca

SEQ ID NO: 19260 - DNA, 44 bp, Human immunodeficiency virus type 1
gggaagttcaattaggaataccacatccagcagggttaaaaaag

SEQ ID NO: 19261 - DNA, 44 bp, Human immunodeficiency virus type 1
gggaggttcaattaggaataccgcacccagcagggttaaaaaag

SEQ ID NO: 19262 - DNA, 48 bp, Human immunodeficiency virus type 1
aaatcagtaacagtactggatgtgggtgatgcatatttttcagttcct

SEQ ID NO: 19263 - DNA, 48 bp, Human immunodeficiency virus type 1
aaatcagtaacagtattagatgtgggggatgcatatttttcagttcct

SEQ ID NO: 19264 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
aaaagaaaaaatcag

SEQ ID NO: 19265 - DNA, 37 bp, Artificial Sequence
  Pan degenerate oligonucleotide primer
  primer_bind (1)..(37): Pan degenerate sense primer that amplifies a region of the HIV-1 genome that incorporates codon 103 of the reverse transcriptase gene.
  misc_feature (32)..(36): Adaptor region of the pan degenerate sense primer that adapts the probe-binding site upstream of codon 103 to correspond to the nucleotides in an oligonucleotide probe upstream of the discriminating single nucleotide polymorphism.
carytaggrataccdcaycchgcrggdytraaaaaga

SEQ ID NO: 19266 - DNA, 95 bp, Human immunodeficiency virus type 1
gggargtycarytaggrataccdcaycchgcrggdytraaaaagaaaaaatcagtracagtrytrgatgtrggdgatgcatayttytcagtyccy

SEQ ID NO: 19267 - DNA, 95 bp, Human immunodeficiency virus type 1
gggaagttcaattaggaataccacatccagcagggttaaaaaagaaaaaatcagtaacagtactagatgtgggggatgcatatttttcagttcct

SEQ ID NO: 19268 - DNA, 95 bp, Human immunodeficiency virus type 1
gggaagtccaattaggaatacctcatcctgcaggattaaaacagaaaaaatcagtaacagtactagacgtgggggatgcatatttttcagttcct

SEQ ID NO: 19269 - DNA, 95 bp, Human immunodeficiency virus type 1
gggaagttcaattaggaataccgcatccagcaggtttaaaaaagaaaaaatcagtaacagtactagatgtgggagatgcatatttttcagttcct

SEQ ID NO: 19270 - DNA, 95 bp, Human immunodeficiency virus type 1
gggaggttcaattaggaataccacatcctgcagggttaaaaaagaaaaagtcagtaacagtactggatgtgggggatgcatatttttcagttccc

SEQ ID NO: 19271 - DNA, 95 bp, Human immunodeficiency virus type 1; identical to SEQ ID NO: 19269

SEQ ID NO: 19272 - DNA, 95 bp, Human immunodeficiency virus type 1
gggaagttcagttaggaataccacatccagcaggactaaaaaagaaaaaatcagtaacagtactagatgtgggggacgcatatttttctgttccc

SEQ ID NO: 19273 - DNA, 95 bp, Human immunodeficiency virus type 1
gggaagtacaattaggaataccacatcctgcagggctgaaaaagaaaaaatcagtaacagtactggatgtgggtgatgcatatttcttcgttccc

SEQ ID NO: 19274 - DNA, 95 bp, Human immunodeficiency virus type 1
gggaagtacaattaggaataccacatcccgcagggttaaaaaagaaaaaatccgtaacagtcttggatgtgggtgatgcatatttctcagttcct

SEQ ID NO: 19275 - DNA, 95 bp, Human immunodeficiency virus type 1
gggaagttcaactaggaataccacatcctgcagggctaaaaaagaaaaaatcagtaacagtactggatgtgggtgatgcatatttttcagttccc

SEQ ID NO: 19276 - DNA, 95 bp, Human immunodeficiency virus type 1
gggaagttcaattaggaataccgcatccagcaggtttaaaaaagaaaaaatcagtaacagtactagatgtgggggacgcatatttttcagttcct

SEQ ID NO: 19277 - DNA, 95 bp, Human immunodeficiency virus type 1
gggaagtccaactaggaataccgcatccagcgggactaaaaaagaaaaaatcagtaacagtactggatgtgggggacgcatatttttcagttcct

SEQ ID NO: 19278 - DNA, 95 bp, Human immunodeficiency virus type 1
gggaggtccaattaggaatacctcatcccgcggggttaaaaaagaaaagatcagtaacagtattagatgtaggggatgcatatttttcagttccc

SEQ ID NO: 19279 - DNA, 95 bp, Human immunodeficiency virus type 1
gggaagttcaattaggaataccacatccagcagggttaaaaaagaaaaaatcagtgacagtactagatgtgggggatgcatatttttcagttcct

SEQ ID NO: 19280 - DNA, 95 bp, Human immunodeficiency virus type 1
gggaagttcaattaggaataccacatcccgcggggttaaaaaagaaaaaatcagtaacagtactagatgtgggtgatgcatatttttcagttccc

SEQ ID NO: 19281 - DNA, 95 bp, Human immunodeficiency virus type 1
gggaagttcaattaggaataccacatcccgcagggttaaaaaagaaaaaatcagtaacagtactagatgtaggtgatgcatatttttcagtcccc

SEQ ID NO: 19282 - DNA, 95 bp, Human immunodeficiency virus type 1
gggaagttcaattaggaataccacatccagcaggtttaaaaaagaaaaaatcagtgacagtactagatgtgggagatgcatatttttcagttcct

SEQ ID NO: 19283 - DNA, 95 bp, Human immunodeficiency virus type 1
gggaagttcaattaggaataccacacccagcagggttaaaaaagaaaaaatcagtgacagtactggatgtgggggatgcatatttttcagttcct

SEQ ID NO: 19284 - DNA, 95 bp, Human immunodeficiency virus type 1
gggaggttcaattaggaataccacacccagcagggttaaaaaagaaaaaatcagtgacagtactggatgtgggggatgcatatttttcagttcct

SEQ ID NO: 19285 - DNA, 95 bp, Newcastle disease virus
gggaagtccaattaggaataccacacccagcaggattaaaaaagaaaaaatcagtaacagtactagatgtgggggatgcatatttttcagttcct

SEQ ID NO: 19286 - DNA, 99 bp, Newcastle disease virus
  misc_feature (25)..(25): n is a, c, g, t or u
gathcaagrrtcygyrwcyacrtcnrgrggrrrgagrcrgaaacgcttyataggugcyrttathggyagtrtrgctctyggrgtygcracdkcdgcaca

SEQ ID NO: 19287 - DNA, 99 bp, Newcastle disease virus
gatacaagagtctgcgactatctccgaaggaaggaggcggagacgctttgtaggugccatcataggcagtgtggctcttggggttgcgacagctgcaca

SEQ ID NO: 19288 - DNA, 99 bp, Newcastle disease virus
gatacaagggtctgtctccacatctggaggaagacgacagagacgctttgtaggugcagtcattggcagtgtagctctcggggttgcaacagcggcaca

SEQ ID NO: 19289 - DNA, 99 bp, Newcastle disease virus; identical to SEQ ID NO: 19288

SEQ ID NO: 19290 - DNA, 99 bp, Newcastle disease virus
gatacaagggtctgtgtccacatctggaggaagacgacagagacgctttgtaggugcagtcattggcagtgtagctcttggggttgcaacagcggcaca

SEQ ID NO: 19291 - DNA, 99 bp, Newcastle disease virus
gatacaagggtctgtgtccacatctgggggaagacgacagagacgctttgtaggugcagtcattggcagtgtagctcttggggttgcaacagcggcaca

SEQ ID NO: 19292 - DNA, 99 bp, Newcastle disease virus
gatacaagggtctgtgtccacatccggaggaagaagacgaagacgctttgtaggugcagtcatcggcagtgtagctcttggggttgcaacagcggcaca

SEQ ID NO: 19293 - DNA, 99 bp, Newcastle disease virus
gatacaagggtctgtgtccacatctggaggaagaagacgaagacgctttgtaggugcagtcatcggcagtgtagcccttggggttgcaacagcggcaca

SEQ ID NO: 19294 - DNA, 99 bp, Newcastle disease virus
aatacaagagtctgtgtctacatcgggaggaaggagacagagacgatttgtaggugctgtcattggcagtgtagctctaggggttgcaacagctgcaca

SEQ ID NO: 19295 - DNA, 99 bp, Newcastle disease virus
gatacaagggtctgtatctacaacaggaggaaggagacagagacgctttgtaggugctatcatcggtagtgtggctctcggggtcgcaacagcagcaca

SEQ ID NO: 19296 - DNA, 99 bp, Newcastle disease virus
gatacaagggtctgtgtccacatctggaggaagacgacggagacgttttgtaggugcggtcattggtagtgtagctcttggggttgcaacagcagcaca

SEQ ID NO: 19297 - DNA, 99 bp, Newcastle disease virus
  misc_feature (84)..(84): n is a, c, g, t or u
gatacaagggtctgtgactacatctggagggaggagacagaggcgctttgtaggugccgtcatcggtagtgtagccctcggagntgcaacagctgcaca

SEQ ID NO: 19298 - DNA, 99 bp, Newcastle disease virus
gatacaagggtctgtgtctacatctggagggaggagacggaggcgctttgtaggugccgtcattggcagtgtagctcttggggttgcaacagcggcaca

SEQ ID NO: 19299 - DNA, 99 bp, Newcastle disease virus
aatccaagagtcggtaaccacatcaggaggaaaacggcagaggcgttttgtaggggcaataataggaggtgtcgcattaggtgtagccaccgcagcgca

SEQ ID NO: 19300 - DNA, 99 bp, Newcastle disease virus
gatacaaggatctgtgtccacatcaagaggaaggagacagagacgctttgtaggugccatcatcggcagtatagcccttggggtcgcgacatcagcgca

SEQ ID NO: 19301 - DNA, 99 bp, Newcastle disease virus
gatacaaggatctgtgtccacatcaagaggaaggagacagagacgctttgtaggugccatcatcggcagtatagcccttggggtcgcgacatcagcaca

SEQ ID NO: 19302 - DNA, 99 bp, Newcastle disease virus
aatacaagagtctgtgtctacatcgggagggaggagacagagacgatttgtaggugctgtcattggcagtgtagctctaggggttgcaacagctgcaca

SEQ ID NO: 19303 - DNA, 99 bp, Newcastle disease virus
gatacaggggtctgtgtccgcatcaggaggaaggagacagagacgcttcgtaggugccatcatcggcagtgtagctcttggggtcgcaacatcggcaca

SEQ ID NO: 19304 - DNA, 99 bp, Newcastle disease virus; identical to SEQ ID NO: 19299

SEQ ID NO: 19305 - DNA, 99 bp, Newcastle disease virus
gatacaagagtctgtaactacatctggagggaggagacagagacgctttgtaggcgccatcattggcggtgtggctcttggggtggcaactgctgcaca

SEQ ID NO: 19306 - DNA, 47 bp, Artificial Sequence
  Pan degenerate oligonucleotide primer
tytgggaagttcaattaggaataccrcatccmgcaggkttaaaaaag

SEQ ID NO: 19307 - DNA, 47 bp, Artificial Sequence
  Pan degenerate oligonucleotide primer
gaaaaaattkggacgmcctacrccataaggattaacttgaagggtyt

SEQ ID NO: 19308 - DNA, 55 bp, Artificial Sequence
  Pan degenerate oligonucleotide primer
  misc_binding (1)..(8): GC repeat to promote the formation of a stem loop structure in the product(s) of primer-dimer amplification.
cgcgcgcgtytgggaagttcaattaggaataccrcatccmgcaggkttaaaaaag

SEQ ID NO: 19309 - DNA, 55 bp, Artificial Sequence
  Pan degenerate oligonucleotide primer
  misc_binding (1)..(8): GC repeat to promote the formation of a stem loop structure in the product(s) of primer-dimer amplification.
gaaaaaattkggacgmcctacrccataaggattaacttgaagggtytgcgcgcgc

SEQ ID NO: 19310 - DNA, 55 bp, Artificial Sequence; identical to SEQ ID NO: 19308
  Pan degenerate oligonucleotide primer
  misc_binding (1)..(8): GC repeat to promote the formation of a stem loop structure in the product(s) of primer-dimer amplification.

SEQ ID NO: 19311 - DNA, 55 bp, Artificial Sequence; identical to SEQ ID NO: 19309
  Pan degenerate oligonucleotide primer
  misc_binding (1)..(8): GC repeat to promote the formation of a stem loop structure in the product(s) of primer-dimer amplification.

SEQ ID NO: 19312 - DNA, 96 bp, Artificial Sequence
  Amplification product of primer-dimer formation
  misc_binding (1)..(8): 5' GC repeat that was incorporated into the product(s) of primer-dimer amplification.
  misc_binding (89)..(96): 3' GC repeat that was incorporated into the product(s) of primer-dimer amplification.
cgcgcgcgtytgggaagttcaattaggaataccrcatccmgcaggkttaaaaaagckggatgyggtattcctaattgaacttcccaracgcgcgcg

SEQ ID NO: 19313 - DNA, 55 bp, Artificial Sequence; identical to SEQ ID NO: 19309
  Pan degenerate oligonucleotide primer
  misc_binding (1)..(8): GC repeat to promote the formation of a stem loop structure in the product(s) of primer-dimer amplification.

SEQ ID NO: 19314 - DNA, 96 bp, Artificial Sequence; identical to SEQ ID NO: 19312
  Amplification product of primer-dimer formation after introduction of an 8 nucleotide GC into the oligionucleotide primers
  misc_binding (1)..(8): 5' GC repeat that was incorporated into the product(s) of primer-dimer amplification.
  misc_binding (89)..(96): 3' GC repeat that was incorporated into the product(s) of primer-dimer amplification.

SEQ ID NO: 19315 - DNA, 44 bp, Artificial Sequence
  Pan degenerate oligonucleotide primer
gggargtycarytaggrataccdcaycchgcrggdytraaaaag

SEQ ID NO: 19316 - DNA, 44 bp, Artificial Sequence
  Pan degenerate oligonucleotide primer
gggaagttcaattaggaataccacatccagcgggtttaaaaaag

SEQ ID NO: 19317 - DNA, 44 bp, Artificial Sequence
  Pan degenerate oligonucleotide primer
gggaagttcaattaggaataccgcatccagcaggtttaaaaaag

SEQ ID NO: 19318 - DNA, 44 bp, Artificial Sequence
  Pan degenerate oligonucleotide primer
gggaagttcaattaggaataccacatcccgcagggttaaaaaag

SEQ ID NO: 19319 - DNA, 44 bp, Artificial Sequence; identical to SEQ ID NO: 19261
  Pan degenerate oligonucleotide primer

SEQ ID NO: 19320 - DNA, 44 bp, Artificial Sequence
  Pan degenerate oligonucleotide primer
gggaagttcaactaggaataccacatcctgcagggctaaaaaag

SEQ ID NO: 19321 - DNA, 48 bp, Artificial Sequence
  Pan degenerate oligonucleotide primer
aaatcagtracagtrytrgatgtrggdgatgcatayttytcagtyccy

SEQ ID NO: 19322 - DNA, 48 bp, Artificial Sequence
  Pan degenerate oligonucleotide primer
aaatcagtaacagtactagatgtgggggacgcatatttttcagttcct

SEQ ID NO: 19323 - DNA, 48 bp, Artificial Sequence
  Pan degenerate oligonucleotide primer
aaatcagtaacagtactagatgtgggagatgcatatttttcagttcct

SEQ ID NO: 19324 - DNA, 48 bp, Artificial Sequence
  Pan degenerate oligonucleotide primer
aaatcagtaacagtactggatgtgggtgatgcatatttttcagttccc

SEQ ID NO: 19325 - DNA, 48 bp, Artificial Sequence; identical to SEQ ID NO: 19263
  Pan degenerate oligonucleotide primer

SEQ ID NO: 19326 - DNA, 48 bp, Artificial Sequence; identical to SEQ ID NO: 19324
  Pan degenerate oligonucleotide primer

SEQ ID NO: 19327 - DNA, 95 bp, Newcastle disease virus
  misc_feature (25)..(25): n is a, c, g, or t
gathcaagrrtcygyrwcyacrtcnrgrggrrrgagrcrgaaacgcttyataggtgcyrttathggyagtrtrgctctyggrgtygcracdkcdg

SEQ ID NO: 19328 - DNA, 111 bp, Newcastle disease virus
ggtgattccatccgcaggatacaagggtctgtgtccacatcaggagtaaggaggaagaaacgctttataggtgccattataggcagtgtagctcttggggttgcgacatcg

SEQ ID NO: 19329 - DNA, 111 bp, Newcastle disease virus
ggtgactctatccgcagaatacaagggtctgcgactacatctggaggaaggagacagaaacgctttgtaggtgccattatcggcagtgtagctcttggggttgcaacagct

SEQ ID NO: 19330 - DNA, 25 bp, Artificial Sequence
  Oligonucleotide probe
ggtgagtctatccggagaatacaag

SEQ ID NO: 19331 - DNA, 18 bp, Artificial Sequence
  Oligonucleotide probe
cttggggttgcaacagct
